US009982258B2

(12) United States Patent
Raemaekers et al.

(10) Patent No.: US 9,982,258 B2
(45) Date of Patent: *May 29, 2018

(54) METHODS FOR CONTROLLING PESTS USING RNAI

(71) Applicants: Romaan Raemaekers, De Pinte (BE); Pascale Feldmann, Ghent (BE); Geert Plaetinck, Bottelare (BE); Irene Nooren, Oegstgeest (NL); Frederic Pecqueur, Sequedin (FR); Laurent Kubler, Beynost (FR); Nicole Damme, Kruishoutem (BE); Lies Degrave, Tieet (BE); Isabel Remory, Ressegem (BE); Thierry Bogaert, Kortrijk (BE)

(72) Inventors: Romaan Raemaekers, De Pinte (BE); Pascale Feldmann, Ghent (BE); Geert Plaetinck, Bottelare (BE); Irene Nooren, Oegstgeest (NL); Els Van Bleu, Berlare (BE); Frederic Pecqueur, Sequedin (FR); Laurent Kubler, Beynost (FR); Nicole Damme, Kruishoutem (BE); Lies Degrave, Tieet (BE); Isabel Remory, Ressegem (BE); Thierry Bogaert, Kortrijk (BE)

(73) Assignee: Devgen NV (BE)

( * ) Notice: Subject to any disclaimer, the term of this patent is extended or adjusted under 35 U.S.C. 154(b) by 0 days. days.

This patent is subject to a terminal disclaimer.

(21) Appl. No.: 14/485,103

(22) Filed: Sep. 12, 2014

(65) Prior Publication Data

US 2015/0065557 A1   Mar. 5, 2015

Related U.S. Application Data

(60) Division of application No. 11/992,091, filed as application No. PCT/IB2006/004008 on Sep. 18, 2006, now Pat. No. 8,933,042, which is a continuation-in-part of application No. PCT/IB2006/003446, filed on Sep. 15, 2006.

(60) Provisional application No. 60/718,034, filed on Sep. 16, 2005, provisional application No. 60/758,191, filed on Jan. 12, 2006, provisional application No. 60/771,160, filed on Feb. 7, 2006, provisional application No. 60/837,910, filed on Aug. 16, 2006.

(51) Int. Cl.
| | |
|---|---|
| *C12N 15/11* | (2006.01) |
| *C12N 15/113* | (2010.01) |
| *A01N 63/02* | (2006.01) |
| *C12N 15/82* | (2006.01) |

(52) U.S. Cl.
CPC ............ *C12N 15/113* (2013.01); *A01N 63/02* (2013.01); *C12N 15/8286* (2013.01); *C12N 2310/14* (2013.01)

(58) Field of Classification Search
None
See application file for complete search history.

(56) References Cited

U.S. PATENT DOCUMENTS

| | | | |
|---|---|---|---|
| 7,576,261 B2 | 8/2009 | Hussey et al. | |
| 7,655,785 B1 * | 2/2010 | Bentwich | ............ 536/24.1 |
| 7,943,819 B2 * | 5/2011 | Baum et al. | ............ 800/285 |
| 2004/0077565 A1 * | 4/2004 | Pavco et al. | ............ 514/44 |
| 2005/0246794 A1 * | 11/2005 | Khvorova et al. | ............ 800/286 |
| 2012/0164205 A1 * | 6/2012 | Baum | ............ A01N 63/02 |
| | | | 424/409 |

FOREIGN PATENT DOCUMENTS

| | | |
|---|---|---|
| WO | WO 01/09301 | 2/2001 |
| WO | WO 01/34815 | 5/2001 |
| WO | WO 01/37654 | 5/2001 |
| WO | WO 02/46432 | 6/2002 |
| WO | WO 03/004644 | 1/2003 |
| WO | WO 2004/001000 | 12/2003 |
| WO | WO 04/02271 | 3/2004 |
| WO | WO 2005/019408 | 3/2005 |
| WO | WO 2005/049841 | 6/2005 |
| WO | WO 2005/071091 | 8/2005 |
| WO | WO 2005/110068 | 11/2005 |
| WO | WO 2006/045590 | 5/2006 |

OTHER PUBLICATIONS

Accession No. MI0009991, stem-loop sequence mmu-mir-1839, accessed and retrieved from www.mirbase.org on Oct. 27, 2015. total 3 pages.*
Elbashir et al., Functional anatomy of siRNAs for mediating efficient RNAi in *Drosophila melanogaster* embryo lysate, 2001, The EMBO Journal, vol. 20, pp. 6877-6888.*
The Notice of References Cited in the related U.S. Appl. No. 11/992,090, dated Oct. 21, 2010.
International Report on Patentability received in the corresponding International Application No. PCT/IB2006/004003. (20 pgs.).
International Search Report for Patent Application No. PCT/IB2006/004008, dated Nov. 20, 2007. (8 pgs.).
Database Accession No. Q4GXU7 abstract, Aug. 30, 2005—"Ribosomal Protein S4e." XP002432593 Longhorn, S.J., Database Accession No. AM048926 abstract, Jul. 16, 2005—"Biphyllus Lunatus mRNA for Ribosomal Protein S4e".
Lamberton, et al., "Varying the Nucleic Acid Composition of Sirna Molecules Dramatically Varies the Duration and Degree of Gene Silencing", *Molecular Biotechnology*, vol. 24, No. 2, 2003, pp. 111-119.

(Continued)

*Primary Examiner* — Dana H Shin
(74) *Attorney, Agent, or Firm* — Toshii D. Barron

(57) ABSTRACT

The present invention relates to methods for controlling pest infestation using double stranded RNA molecules. The invention provides methods for producing transgenic cells expressing the double stranded RNA molecules, as well as compositions and commodity products containing or treated with such molecules.

10 Claims, 28 Drawing Sheets

(56) References Cited

OTHER PUBLICATIONS

Soares, et al., "Capillary feeding of specific dsRNA induces Silencing of the Isac Gene in Nympal Ixodes Scapularis Ticks", Insect Molecular Biology, vol. 14, No. 14, pp. 443-452.
Anna Davison, "The Genome of an Agricultural Pest", Mar. 24, 2008, Technology Review, two print-out pages are enclosed.
Tribolium Genome Sequencing Consortium, The genome of the model beetle and pest *Tribolium castaneum,* 2008, Nature, vol. 452, pp. 949-955.

* cited by examiner

METHODS FOR CONTROLLING PESTS USING RNAI

CROSS REFERENCE TO RELATED APPLICATIONS

This application is a divisional application of, and claims priority to U.S. patent application Ser. No. 11/992,091 filed on May 8, 2008 which is a national stage filing under 35 U.S.C. § 371 of International Application No. PCT/IB2006/004008, filed on Sep. 18, 2006, which claims benefit of International Application No. PCT/IB2006/003446, filed on Sep. 15, 2006, which claims benefit of 60/837,910, filed on Aug. 16, 2006, and claims benefit of 60/771,160, filed on Feb. 7, 2006, and claims benefit of 60/758,191 filed on Jan. 12, 2006, and claims benefit of 60/718,034, filed on Sep. 16, 2005, the contents of each of which are herein incorporated by reference in their entireties.

SEQUENCE LISTING

A Sequence Listing in ASCII text format, submitted under 37 CFR § 1.821, entitled "80386_SEQLIST_ST25.txt", 774 kilobytes in size, generated on Sep. 11, 2014 and filed via EFS-Web is provided in lieu of a paper copy. This sequence listing is hereby incorporated by reference into the specification for its disclosures.

FIELD OF THE INVENTION

The present invention relates generally to genetic control of pest infestations. More specifically, the present invention relates to recombinant technologies for repressing or inhibiting expression of target coding sequences in a pest.

INTRODUCTION

Insect and other pests can cause injury and even death by their bites or stings. Additionally, many pests transmit bacteria and other pathogens that cause diseases. For example, mosquitoes transmit pathogens that cause malaria, yellow fever, encephalitis, and other diseases. The bubonic plague, or black death, is caused by bacteria that infect rats and other rodents. Compositions for controlling microscopic pest infestations have been provided in the form of antibiotic, antiviral, and antifungal compositions. Methods for controlling infestations by pests, such as nematodes and insects, have typically been in the form of chemical compositions that are applied to surfaces on which pests reside, or administered to infested animals in the form of pellets, powders, tablets, pastes, or capsules.

Commercial crops are often the targets of insect attack. Substantial progress has been made in the last a few decades towards developing more efficient methods and compositions for controlling insect infestations in plants. Chemical pesticides have been very effective in eradicating pest infestations. However, there are several disadvantages to using chemical pesticides. Not only are they potentially detrimental to the environment, but chemical pesticides are not selective and can pose harm to non-target flora and fauna. Chemical pesticides persist in the environment and generally are slow to be metabolized, if at all. They accumulate in the food chain, and particularly in the higher predator species. Accumulation of chemical pesticides results in the development of resistance to the agents and in species higher up the evolutionary ladder, they can act as mutagens and/or carcinogens and cause irreversible and deleterious genetic modifications.

Because of the dangers associated with chemical pesticides, biological approaches have been developed for controlling pest infestations. For example, biological control using protein Cry3A from *Bacillus thuringiensis* have effectively controlled Colorado potato beetle larvae either as formulations sprayed onto the foliage or expressed in the leaves of potatoes. An alternative biological agent is double stranded RNA (dsRNA). Over the last few years, downregulation of genes (also referred to as "gene silencing") in multicellular organisms by means of RNA interference has become a well-established technique.

RNA Interference (RNAi) provides a potentially powerful tool for controlling gene expression because of its specificity of target selection and remarkably high efficiency in target mRNA suppression. RNAi refers to the process of sequence-specific post-transcriptional gene silencing mediated by short interfering RNAs (siRNAs) (Zamore, P. et al., *Cell* 101:25-33 (2000); Fire, A. et al., *Nature* 391:806 (1998); Hamilton et al., *Science* 286, 950-951 (1999); Lin et al., *Nature* 402:128-129 (1999)). While the mechanics underlying RNAi are not fully characterized, it is thought that the presence of dsRNA in cells triggers RNAi by activating the ribonuclease III enzyme Dicer (Zamore, P. et al., (2000); Hammond et al., *Nature* 404, 293 (2000)). Dicer processes the dsRNA into short pieces called short interfering RNAs (siRNAs), which are about 21 to about 23 nucleotides long and comprise about 19 base pair duplexes (Zamore et al., (2000); Elbashir et al., *Genes Dev.*, 15, 188 (2001)). Following delivery into cells, the siRNA molecules associate with an endonuclease complex, commonly referred to as an RNA-induced silencing complex (RISC), which brings together the antisense strand of the siRNA and the cellular mRNA gene target. RISC cleaves the mRNA, which is then released and degraded. Importantly, RISC is then capable of degrading additional copies of the target mRNA.

Accordingly, the present invention provides methods and compositions for controlling pest infestation by repressing, delaying, or otherwise reducing gene expression within a particular pest.

SUMMARY OF THE INVENTION

In one aspect, the invention provides an isolated polynucleotide sequence comprising a nucleic acid sequence set forth in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. In one embodiment, a double stranded ribonucleotide sequence is produced from the expression of a polynucleotide sequence, wherein contact of said ribonucleotide sequence by a pest inhibits the growth of said pest. In a further embodiment, contact of the sequence inhibits expression of a nucleotide sequence substantially complementary to said sequence. In another embodiment, a cell is transformed with the polynucleotide. In a further embodiment, the cell is a bacterial, yeast, or algal cell. In a still further embodiment, a food product, such as stored grains, pet food, or powdered chocolate, comprises the cell transformed with the polynucleotide. In yet another embodiment, a composition, such as a spray, powder, pellet, gel, capsule, food product, garment bag, and book, comprising the polynucleotide. In yet another embodiment, the invention provides a pesticide comprising the polynucleotide. In another embodiment, the invention provides a method for protecting an object, such as wood, tree, book binding, cloth, and a food storage container, from pest infestation, comprising treating said surface with a composition comprising the polynucleotide.

In another aspect, the invention provides a polynucleotide sequence having at least 70% sequence identity to a nucleic acid sequence set forth in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. In one embodiment, a double stranded ribonucleotide sequence is produced from the expression of a polynucleotide sequence, wherein contact of said ribonucleotide sequence by a pest inhibits the growth of said pest. In a further embodiment, contact of the sequence inhibits expression of a nucleotide sequence substantially complementary to said sequence. In another embodiment, a cell is transformed with the polynucleotide. In a further embodiment, the cell is a bacterial, yeast, or algal cell. In a still further embodiment, a food product, such as stored grains, pet food, or powdered chocolate, comprises the cell transformed with the polynucleotide. In yet another embodiment, a composition, such as a spray, powder, pellet, gel, capsule, food product, garment bag, and book, comprising the polynucleotide. In yet another embodiment, the invention provides a pesticide comprising the polynucleotide. In another embodiment, the invention provides a method for protecting an object, such as wood, tree, book binding, cloth, and a food storage container, from pest infestation, comprising treating said surface with a composition comprising the polynucleotide.

In another aspect, the invention provides a method for controlling pest infestation, comprising exposing a pest to a composition comprising a polynucleotide sequence that inhibits a pest biological activity. In one embodiment, the polynucleotide sequence is set forth in any of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481.

In other embodiments, the invention provides for the use of the isolated nucleotide sequence, the double stranded ribonucleotide sequence, the cell, the composition, or the pesticide for preventing or treating an infestation, such as insect, nematode, or fungal infestation.

Figure 1:
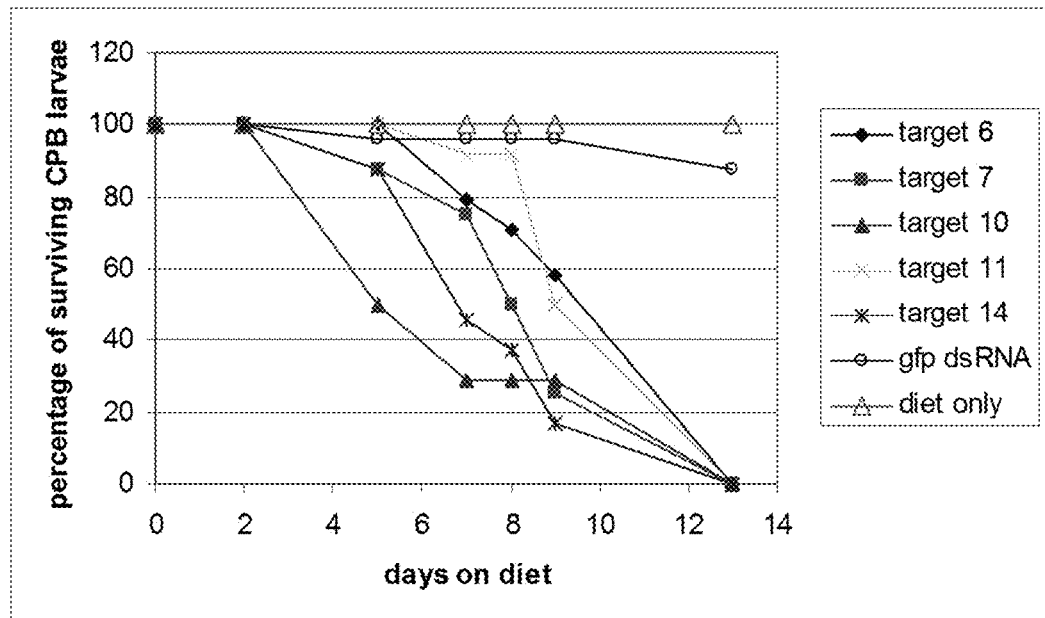
FIG. 1: Survival of L. decemlineata on artificial diet treated with dsRNA. Insects of the second larval stage were fed diet treated with 50 µl of topically-applied solution of dsRNA (targets or gfp control). Diet was replaced with fresh diet containing topically-applied dsRNA after 7 days. The number of surviving insects were assessed at days 2, 5, 7, 8, 9, & 13. The percentage of surviving larvae was calculated relative to day 0 (start of assay). Target LD006: (SEQ ID NO: 178); Target LD007 (SEQ ID NO: 183); Target LD010 (SEQ ID NO: 188); Target LD011 (SEQ ID NO: 193); Target LD014 (SEQ ID NO: 198); gfp dsRNA (SEQ ID NO: 235).

FIG. 20: Effects of ingested target dsRNAs on survival of *E. varivestis* adults and resistance to snap bean foliar insect damage. (20A) Survival of *E. varivestis* adults on bean leaf treated with dsRNA. Adults were fed bean leaf discs treated with 75 µl of topically-applied solution of 0.1 µg/µl dsRNA (targets or gfp control). After 24 hours, the insects were transferred onto fresh dsRNA-treated leaf discs. After a further 24 hours, adults from one treatment were collected and placed in a plastic box containing potted fresh untreated whole bean plants. The insects were assessed for mortality at days 4, 5, 6, 7, 8, & 11. The percentage of surviving adults was calculated relative to day 0 (start of assay). Target 10: SEQ ID NO: 586; target 15: SEQ ID NO: 591; target 16: SEQ ID NO: 596; gfp dsRNA: SEQ ID NO: 235. (20B-20F) Resistance to bean foliar damage caused by adults of the *E. varivestis* by dsRNA. Whole plants containing insects from one treatment (see 20A) were checked visually for foliar damage on day 9. (20B) target 10; (20C) target 15; (20D) target 16; (20E) gfp dsRNA; (20F) untreated.

FIG. 21: Survival of *T. castaneum* larvae on artificial diet treated with dsRNA of target 14. Neonate larvae were fed diet based on a flour/milk mix with 1 mg dsRNA target 14. Control was water (without dsRNA) in diet. Four replicates of 10 first instar larvae per replicate were performed for each treatment. The insects were assessed for survival as average percentage means at days 6, 17, 31, 45 and 60. The percentage of surviving larvae was calculated relative to day 0 (start of assay). Error bars represent standard deviations. Target TC014: SEQ ID NO: 878.

FIG. 22: Effect of ingested target 27 dsRNA on the survival of *Myzus persicae* nymphs. First instars were placed in feeding chambers containing 50 µl of liquid diet with 2 µg/µl dsRNA (target 27 or gfp dsRNA control). Per treatment, 5 feeding chambers were set up with 10 instars in each feeding chamber. Number of survivors were assessed at 8 days post start of bioassay. Error bars represent standard deviations. Target MP027: SEQ ID NO: 1061; gfp dsRNA: SEQ ID NO: 235.

FIG. 23: Survival of *Nilaparvata lugens* on liquid artificial diet treated with dsRNA. Nymphs of the first to second larval stage were fed diet supplemented with 2 mg/ml solution of dsRNA targets in separate bioassays: (23A) NL002, NL003, NL005, NL010; (23B) NL009, NL016; (23C) NL014, NL018; (23D) NL013, NL015, NL021. Insect survival on targets were compared to diet only and diet with gfp dsRNA control at same concentration. Diet was replaced with fresh diet containing dsRNA every two days. The number of surviving insects were assessed every day FIG. 24: Survival of *Nilaparvata lugens* on liquid artificial diet treated with different concentrations of target dsRNA NL002. Nymphs of the first to second larval stage were fed diet supplemented with 1, 0.2, 0.08, and 0.04 mg/ml (final concentration) of NL002. Diet was replaced with fresh diet containing dsRNA every two days. The numbers of surviving insects were assessed every day.

DETAILED DESCRIPTION OF THE INVENTION

The present invention provides a means for controlling pest infestations by exposing a pest to a target coding sequence that post-transcriptionally represses or inhibits a requisite biological function in the pest. Following exposure to a target sequence, the target forms a the dsRNA corresponding to part or whole of an essential pest gene and causes down regulation of the pest target via RNA interference (RNAi). As a result of the down regulation of mRNA, the dsRNA prevents expression of the target pest protein and hence causes death, growth arrest, or sterility of the pest.

The present invention finds application in any area where it is desirable to inhibit viability, growth, development or reproduction of a pest, or to decrease pathogenicity or infectivity of a pest. Practical applications include, but are not limited to, (1) protecting plants against pest infestation; (2) pharmaceutical or veterinary use in humans and animals (for example to control, treat, or prevent insect infections in humans and animals); (3) protecting materials against damage caused by pests; and (4) protecting perishable materials (such as foodstuffs, seed, etc.) against damage caused by pests.

Administering or exposing a double stranded ribonucleic acid molecule to a pest results in one or more of the following attributes: reduction in feeding by the pest, reduction in viability of the pest, death of the pest, inhibition of differentiation and development of the pest, absence of or reduced capacity for sexual reproduction by the pest, muscle formation, juvenile hormone formation, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, apoptosis, and any component of a eukaryotic cells' cytoskeletal structure, such as, for example, actins and tubulins. Any one or any combination of these attributes can result in an effective inhibition of pest infestation.

All technical terms employed in this specification are commonly used in biochemistry, molecular biology and agriculture; hence, they are understood by those skilled in the field to which this invention belongs. Those technical terms can be found, for example in: MOLECULAR CLONING: A LABORATORY MANUAL, 3rd ed., vol. 1-3, ed. Sambrook and Russel, Cold Spring Harbor Laboratory Press, Cold Spring Harbor, N.Y., 2001; CURRENT PROTOCOLS IN MOLECULAR BIOLOGY, ed. Ausubel et al., Greene Publishing Associates and Wiley-Interscience, New York, 1988 (with periodic updates); SHORT PROTOCOLS IN MOLECULAR BIOLOGY: A COMPENDIUM OF METHODS FROM CURRENT PROTOCOLS IN MOLECULAR BIOLOGY, $5^{th}$ ed., vol. 1-2, ed. Ausubel et al., John Wiley & Sons, Inc., 2002; GENOME ANALYSIS: A LABORATORY MANUAL, vol. 1-2, ed. Green et al., Cold Spring Harbor Laboratory Press, Cold Spring Harbor, N.Y., 1997.

Various techniques using PCR are described, for example, in Innis et al., PCR PROTOCOLS: A GUIDE TO METHODS AND APPLICATIONS, Academic Press, San Diego, 1990 and in Dieffenbach and Dveksler, PCR PRIMER: A LABORATORY MANUAL, 2$^{nd}$ ed., Cold Spring Harbor Laboratory Press, Cold Spring Harbor, N.Y., 2003. PCR-primer pairs can be derived from known sequences by known techniques such as using computer programs intended for that purpose, e.g., Primer, Version 0.5, 1991, Whitehead Institute for Biomedical Research, Cambridge, Mass. Methods for chemical synthesis of nucleic acids are discussed, for example, in Beaucage & Caruthers, *Tetra. Letts.* 22: 1859-62 (1981), and Matteucci & Caruthers, *J. Am. Chem. Soc.* 103: 3185 (1981).

Restriction enzyme digestions, phosphorylations, ligations, and transformations were done as described in Sambrook et al., MOLECULAR CLONING: A LABORATORY MANUAL, 2nd ed. (1989), Cold Spring Harbor Laboratory Press. All reagents and materials used for the growth and maintenance of bacterial cells were obtained from Aldrich Chemicals (Milwaukee, Wis.), DIFCO Laboratories (Detroit, Mich.), Invitrogen (Gaithersburg, Md.), or Sigma Chemical Company (St. Louis, Mo.) unless otherwise specified.

Biological activity refers to the biological behavior and effects of a protein or peptide and its manifestations on a pest. For example, an inventive RNAi may prevent translation of a particular mRNA, thereby inhibiting the biological activity of the protein encoded by the mRNA or other biological activity of the pest.

In the present description, an RNAi molecule may inhibit a biological activity in a pest, resulting in one or more of the following attributes: reduction in feeding by the pest, reduction in viability of the pest, death of the pest, inhibition of differentiation and development of the pest, absence of or reduced capacity for sexual reproduction by the pest, muscle formation, juvenile hormone formation, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, apoptosis, and any component of a eukaryotic cells' cytoskeletal structure, such as, for example, actins and tubulins.

Complementary DNA (cDNA) refers to single-stranded DNA synthesized from a mature mRNA template. Though there are several methods, cDNA is most often synthesized from mature (fully spliced) mRNA using the enzyme reverse transcriptase. This enzyme operates on a single strand of mRNA, generating its complementary DNA based on the pairing of RNA base pairs (A, U, G, C) to their DNA complements (T, A, C, G). Two nucleic acid strands are substantially complementary when at least 85% of their bases pair.

Desired Polynucleotide: a desired polynucleotide of the present invention is a genetic element, such as a promoter, enhancer, or terminator, or gene or polynucleotide that is to be transcribed and/or translated in a transformed cell that comprises the desired polynucleotide in its genome. If the desired polynucleotide comprises a sequence encoding a protein product, the coding region may be operably linked to regulatory elements, such as to a promoter and a terminator, that bring about expression of an associated messenger RNA transcript and/or a protein product encoded by the desired polynucleotide. Thus, a "desired polynucleotide" may comprise a gene that is operably linked in the 5'- to 3'-orientation, a promoter, a gene that encodes a protein, and a terminator. Alternatively, the desired polynucleotide may comprise a gene or fragment thereof, in a "sense" or "antisense" orientation, the transcription of which produces nucleic acids that may affect expression of an endogenous gene in the host cell. A desired polynucleotide may also yield upon transcription a double-stranded RNA product upon that initiates RNA interference of a gene to which the desired polynucleotide is associated. A desired polynucleotide of the present invention may be positioned within a vector, such that the left and right border sequences flank or are on either side of the desired polynucleotide. The present invention envisions the stable integration of one or more desired polynucleotides into the genome of at least one host cell. A desired polynucleotide may be mutated or a variant of its wild-type sequence. It is understood that all or part of the desired polynucleotide can be integrated into the genome of a host. It also is understood that the term "desired polynucleotide" encompasses one or more of such polynucleotides. Thus, a vector of the present invention may comprise one, two, three, four, five, six, seven, eight, nine, ten, or more desired polynucleotides.

"Exposing" encompasses any method by which a pest may come into contact with a dsRNA, wherein the dsRNA comprises annealed complementary strands, one of which has a nucleotide sequence which is complementary to at least part of the nucleotide sequence of a pest target gene to be down-regulated. A pest may be exposed to the dsRNA by direct uptake (e.g. by feeding), which does not require expression of dsRNA within the pest. Alternatively, a pest may come into direct contact with a composition comprising the dsRNA. For example, a pest may come into contact with a surface or material treated with a composition comprising a dsRNA. A dsRNA may be expressed by a prokaryotic (for instance, but not limited to, a bacterial) or eukaryotic (for instance, but not limited to, a yeast) host cell or host organism.

Foreign: "foreign," with respect to a nucleic acid, means that that nucleic acid is derived from non-host organisms. According to the present invention, foreign DNA or RNA represents nucleic acids that are naturally occurring in the genetic makeup of viruses, mammals, fish or birds, but are not naturally occurring in the host that is to be transformed. Thus, a foreign nucleic acid is one that encodes, for instance, a polypeptide that is not naturally produced by the transformed host. A foreign nucleic acid does not have to encode a protein product.

Gene: refers to a polynucleotide sequence that comprises control and coding sequences necessary for the production of a polypeptide or precursor. The polypeptide can be encoded by a full length coding sequence or by any portion of the coding sequence. A gene may constitute an uninterrupted coding sequence or it may include one or more introns, bound by the appropriate splice junctions. Moreover, a gene may contain one or more modifications in either the coding or the untranslated regions that could affect the biological activity or the chemical structure of the expression product, the rate of expression, or the manner of expression control. Such modifications include, but are not limited to, mutations, insertions, deletions, and substitutions of one or more nucleotides. In this regard, such modified genes may be referred to as "variants" of the "native" gene.

Genetic element: a "genetic element" is any discreet nucleotide sequence such as, but not limited to, a promoter, gene, terminator, intron, enhancer, spacer, 5'-untranslated region, 3'-untranslated region, or recombinase recognition site.

Genetic modification: stable introduction of a nucleic acid into the genome of certain organisms by applying methods in molecular and cell biology.

"Gene suppression" or "down-regulation of gene expression" or "inhibition of gene expression" are used interchangeably and refer to a measurable or observable reduction in gene expression or a complete abolition of detectable gene expression, at the level of protein product and/or mRNA product from the target gene. Down-regulation or inhibition of gene expression is "specific" when down-regulation or inhibition of the target gene occurs without manifest effects on other genes of the pest.

Depending on the nature of the target gene, down-regulation or inhibition of gene expression in cells of a pest can be confirmed by phenotypic analysis of the cell or the whole pest or by measurement of mRNA or protein expression using molecular techniques such as RNA solution hybridization, nuclease protection, Northern hybridization, reverse transcription, gene expression monitoring with a microarray, antibody binding, enzyme-linked immunosorbent assay (ELISA), Western blotting, radioimmunoassay (RIA), other immunoassays, or fluorescence-activated cell analysis (FACS).

Gymnosperm, as used herein, refers to a seed plant that bears seed without ovaries. Examples of gymnosperms include conifers, cycads, ginkgos, and ephedras.

Homology, as used herein relates to sequences; Protein, or nucleotide sequences are likely to be homologous if they show a "significant" level of sequence similarity or more preferably sequence identity. Truly homologous sequences are related by divergence from a common ancestor gene. Sequence homologs can be of two types: (i) where homologs exist in different species they are known as orthologs. e.g. the α-globin genes in mouse and human are orthologs; (ii) paralogues are homologous genes in within a single species. e.g. the α- and β-globin genes in mouse are paralogs.

Host cell: refers to a microorganism, a prokaryotic cell, a eukaryotic cell, or cell line cultured as a unicellular entity that may be, or has been, used as a recipient for a recombinant vector or other transfer of polynucleotides, and includes the progeny of the original cell that has been transfected. The progeny of a single cell may not necessarily be completely identical in morphology or in genomic or total DNA complement as the original parent due to natural, accidental, or deliberate mutation.

Introduction: as used herein, refers to the insertion of a nucleic acid sequence into a cell, by methods including infection, transfection, transformation, or transduction.

Insect pests as used herein pests are include but are not limited to: from the order Lepidoptera, for example, *Acleris* spp., *Adoxophyes* spp., *Aegeria* spp., *Agrotis* spp., *Alabama argillaceae*, *Amylois* spp., *Anticarsia gemmatalis*, *Archips* spp, *Argyrotaenia* spp., *Autographa* spp., *Busseola fusca*, *Cadra cautella*, *Carposina nipponensis*, *Chilo* spp., *Choristoneura* spp., *Clysia ambiguella*, *Cnaphalocrocis* spp., *Cnephasia* spp., *Cochylis* spp., *Coleophora* spp., *Crocidolomia binotalis*, *Cryptophlebia leucotreta*, *Cydia* spp., *Diatraea* spp., *Diparopsis castanea*, *Earias* spp., *Ephestia* spp., *Eucosma* spp., *Eupoecilia ambiguella*, *Euproctis* spp., *Euxoa* spp., *Grapholita* spp., *Hedya nubiferana*, *Heliothis* spp., *Hellula undalis*, *Hyphantria cunea*, *Keiferia lycopersicella*, *Leucoptera scitella*, *Lithocollethis* spp., *Lobesia botrana*, *Lymantria* spp., *Lyonetia* spp., *Malacosoma* spp., *Mamestra brassicae*, *Manduca sexta*, *Operophtera* spp., *Ostrinia Nubilalis*, *Pammene* spp., *Pandemis* spp., *Panolis flammea*, *Pectinophora gossypiella*, *Phthorimaea operculella*, *Pieris rapae*, *Pieris* spp., *Plutella xylostella*, *Prays* spp., *Scirpophaga* spp., *Sesamia* spp., *Sparganothis* spp., *Spodoptera* spp., *Synanthedon* spp., *Thaumetopoea* spp., *Tortrix* spp., *Trichoplusia ni* and *Yponomeuta* spp.;

from the order Coleoptera, for example, *Agriotes* spp., *Anthonomus* spp., *Atomaria linearis*, *Chaetocnema tibialis*, *Cosmopolites* spp., *Curculio* spp., *Dermestes* spp., *Epilachna* spp., *Eremnus* spp., *Leptinotarsa decemlineata*, *Lissorhoptrus* spp., *Melolontha* spp., *Orycaephilus* spp., *Otiorhynchus* spp., *Phlyctinus* spp., *Popillia* spp., *Psylliodes* spp., *Rhizopertha* spp., Scarabeidae, *Sitophilus* spp., *Sitotroga* spp., *Tenebrio* spp., *Tribolium* spp. and *Trogoderma* spp.;

from the order Orthoptera, for example, *Blatta* spp., *Blattella* spp., *Gryllotalpa* spp., *Leucophaea maderae*, *Locusta* spp., *Periplaneta* ssp., and *Schistocerca* spp.;

from the order Isoptera, for example, *Reticulitemes* ssp;

from the order Psocoptera, for example, *Liposcelis* spp.;

from the order Anoplura, for example, *Haematopinus* spp., *Linognathus* spp., *Pediculus* spp., *Pemphigus* spp. and *Phylloxera* spp.;

from the order Mallophaga, for example, *Damalinea* spp. and *Trichodectes* spp.;

from the order Thysanoptera, for example, *Franklinella* spp., *Hercinothrips* spp., *Taeniothrips* spp., *Thrips palmi*, *Thrips tabaci* and *Scirtothrips aurantii*;

from the order Heteroptera, for example, *Cimex* spp., *Distantiella theobroma*, *Dysdercus* spp., *Euchistus* spp., *Eurygaster* spp., *Leptocorisa* spp., *Nezara* spp., *Piesma* spp., *Rhodnius* spp., *Sahlbergella singularis*, *Scotinophara* spp., *Triatoma* spp., *Miridae family* spp. such as *Lygus hesperus* and *Lygus lineoloris*, Lygaeidae family spp. such as *Blissus leucopterus*, and Pentatomidae family spp.;

from the order Homoptera, for example, *Aleurothrixus floccosus*, *Aleyrodes brassicae*, *Aonidiella* spp., Aphididae, *Aphis* spp., *Aspidiotus* spp., *Bemisia tabaci*, *Ceroplaster* spp., *Chrysomphalus aonidium*, *Chrysomphalus dictyospermi*, *Coccus hesperidum*, *Empoasca* spp., *Eriosoma larigerum*, *Erythroneura* spp., *Gascardia* spp., *Laodelphax* spp., *Lacanium corni*, *Lepidosaphes* spp., *Macrosiphus* spp., *Myzus* spp., *Nehotettix* spp., *Nilaparvata* spp., *Paratoria* spp., *Pemphigus* spp., *Planococcus* spp., *Pseudaulacaspis* spp., *Pseudococcus* spp., *Psylla* ssp., *Pulvinaria aethiopica*, *Quadraspidiotus* spp., *Rhopalosiphum* spp., *Saissetia* spp., *Scaphoideus* spp., *Schizaphis* spp., *Sitobion* spp., *Trialeurodes vaporariorum*, *Trioza erytreae* and *Unaspis citri*;

from the order Hymenoptera, for example, *Acromyrmex*, *Atta* spp., *Cephus* spp., *Diprion* spp., Diprionidae, *Gilpinia polytoma*, *Hoplocampa* spp., *Lasius* spp., *Monomorium pharaonis*, *Neodiprion* spp, *Solenopsis* spp. and *Vespa* ssp.;

from the order Diptera, for example, *Aedes* spp., *Antherigona soccata*, *Bibio hortulanus*, *Calliphora erythrocephala*, *Ceratitis* spp., *Chrysomyia* spp., *Culex* spp., *Cuterebra* spp., *Dacus* spp., *Drosophila melanogaster*, *Fannia* spp., *Gastrophilus* spp., *Glossina* spp., *Hypoderma* spp., *Hyppobosca* spp., *Liriomysa* spp., *Lucilia* spp., *Melanagromyza* spp., *Musca* ssp., *Oestrus* spp., *Orseolia* spp., *Oscinella fit*, *Pegomyia hyoscyami*, *Phorbia* spp., *Rhagoletis pomonella*, *Sciara* spp., *Stomoxys* spp., *Tabanus* spp., *Tannia* spp. and *Tipula* spp., from the order Siphonaptera, for example, *Ceratophyllus* spp. and *Xenopsylla cheopis* and from the order Thysanura, for example, *Lepisma saccharina*.

Monocotyledonous plant (monocot) is a flowering plant having embryos with one cotyledon or seed leaf, parallel leaf veins, and flower parts in multiples of three. Examples of monocots include, but are not limited to turfgrass, maize, rice, oat, wheat, barley, sorghum, orchid, iris, lily, onion, and palm.

Pest or target pest refers to insects, arachnids, crustaceans, fungi, bacteria, viruses, nematodes, flatworms, roundworms, pinworms, hookworms, tapeworms, trypanosomes, schistosomes, botflies, fleas, ticks, mites, and lice and the like that are pervasive in the human environment. A pest may ingest or contact one or more cells, tissues, or products produced by an organism transformed with a double stranded gene suppression agent, as well as a material or surface treated with a double stranded gene suppression agent.

Nematodes, or roundworms, are one of the most common phyla of animals, with over 20,000 different described species (over 15,000 are parasitic). They are ubiquitous in freshwater, marine, and terrestrial environments, where they often outnumber other animals in both individual and species counts, and are found in locations as diverse as Antarctica and oceanic trenches. Further, there are a great many parasitic forms, including pathogens in most plants and animals.

Nematode pests of a particular interest include, for example, *A. caninum, A. ceylancium, H. contortus, O. ostertagi, C. elegans, C. briggsae, P. pacificus, S. stercoralis, S. ratti, P. trichosuri, M. arenaria, M. chitwoodi, M. hapla, M. incognita, M. javanica, M. paraensis, G. rostochiensis, G. pallida, H. glycines, H. schattii, P. penetrans, P. vulnus, R. similis, Z. punctata, A. suum, T. canis, B. malayi, D. immitis, O. volvulus, T. vulpis, T. spiralis, X. index. A. duodenale, A. lumbricoides,* as well as species from the following genera: *Aphelenchoides, Nacobbus, Ditylenchus, Longidorus, Trichodorus,* and *Bursaphelenchus.*

Normal cell refers to a cell of an untransformed phenotype or exhibiting a morphology of a non-transformed cell of the tissue type being examined.

Operably linked: combining two or more molecules in such a fashion that in combination they function properly in a cell. For instance, a promoter is operably linked to a structural gene when the promoter controls transcription of the structural gene.

Orthologs are genes that are related by vertical descent from a common ancestor and encode proteins with the same function in different species. Due to their separation following a speciation event, orthologs may diverge, but usually have similarity at the sequence and structure levels. Two genes that are derived from a common ancestor and encode proteins with similar function are referred to as orthologous. Identification of orthologs is critical for reliable predictions of gene function in newly sequenced genomes.

"Pest control agent", or "gene suppression agent" refers to a particular RNA molecule comprising a first RNA segment and a second RNA segment, wherein the complementarity between the first and the second RNA segments results in the ability of the two segments to hybridize in vivo and in vitro to form a double stranded molecule. It may generally be preferable to include a third RNA segment linking and stabilizing the first and second sequences such that a stem can be formed linked together at one end of each of the first and second segments by the third segment to forms a loop, so that the entire structure forms into a stem and loop structure, or even more tightly hybridizing structures may form into a stem-loop knotted structure. Alternatively, a symmetrical hairpin could be formed without a third segment in which there is no designed loop, but for steric reasons a hairpin would create its own loop when the stem is long enough to stabilize itself. The first and the second RNA segments will generally lie within the length of the RNA molecule and be substantially inverted repeats of each other and linked together by the third RNA segment. The first and the second segments correspond invariably and not respectively to a sense and an antisense sequence with respect to the target RNA transcribed from the target gene in the target insect pest that is suppressed by the ingestion of the dsRNA molecule.

The pest control agent can also be a substantially purified (or isolated) nucleic acid molecule and more specifically nucleic acid molecules or nucleic acid fragment molecules thereof from a genomic DNA (gDNA) or cDNA library. Alternatively, the fragments may comprise smaller oligonucleotides having from about 15 to about 250 nucleotide residues, and more preferably, about 15 to about 30 nucleotide residues.

Pesticide refers to any substance or mixture of substances intended for preventing, destroying, repelling, or mitigating any pest. A pesticide may be a chemical substance or biological agent used against pests including insects, pathogens, weeds, nematodes, and microbes that compete with humans for food, destroy property, spread disease, or are a nuisance.

Phenotype is a distinguishing feature or characteristic of an organism, which may be altered according to the present invention by integrating one or more "desired polynucleotides" and/or screenable/selectable markers into the genome of at least one cell of a transformed organism. The "desired polynucleotide(s)" and/or markers may confer a change in the phenotype of a transformed organism, by modifying any one of a number of genetic, molecular, biochemical, physiological, or morphological characteristics or properties of the transformed cell or organism as a whole.

Plant and plant tissue: a "plant" is any of various photosynthetic, eukaryotic, multicellular organisms of the kingdom Plantae characteristically producing embryos, containing chloroplasts, and having cellulose cell walls. A part of a plant, i.e., a "plant tissue" may be treated according to the methods of the present invention to prevent pest infestation on the plant or on the part of the plant. Many suitable plant tissues can be treated according to the present invention and include, but are not limited to, somatic embryos, pollen, leaves, stems, calli, stolons, microtubers, and shoots. Thus, the present invention envisions the treatment of angiosperm and gymnosperm plants such as acacia, alfalfa, apple, apricot, artichoke, ash tree, asparagus, avocado, banana, barley, beans, beet, birch, beech, blackberry, blueberry, broccoli, brussels sprouts, cabbage, canola, cantaloupe, carrot, cassava, cauliflower, cedar, a cereal, celery, chestnut, cherry, chinese cabbage, citrus, clementine, clover, coffee, corn, cotton, cowpea, cucumber, cypress, eggplant, elm, endive, eucalyptus, fennel, figes, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, soybean, spinach, spruce, squash, strawberry, sugarbeet, sugarcane, sunflower, sweet potato, sweet corn, tangerine, tea, tobacco, tomato, trees, triticale, turf grasses, turnips, a vine, walnut, watercress, watermelon, wheat, yams, yew, and zucchini.

According to the present invention "plant tissue" also encompasses plant cells. Plant cells include suspension cultures, callus, embryos, meristematic regions, callus tissue, leaves, roots, shoots, gametophytes, sporophytes, pollen, seeds and microspores. Plant tissues may be at various stages of maturity and may be grown in liquid or solid culture, or in soil or suitable media in pots, greenhouses or fields. A plant tissue also refers to any clone of such a plant, seed, progeny, propagule whether generated sexually or asexually, and descendents of any of these, such as cuttings or seed.

Promoter is intended to mean a nucleic acid, preferably DNA that binds RNA polymerase and/or other transcription regulatory elements. As with any promoter, the promoters of the current invention will facilitate or control the transcription of DNA or RNA to generate an mRNA molecule from a nucleic acid molecule that is operably linked to the promoter. As stated earlier, the RNA generated may code for a protein or polypeptide or may code for an RNA interfering, or antisense molecule.

Polynucleotide is a nucleotide sequence, comprising a gene coding sequence or a fragment thereof, a promoter, an intron, an enhancer region, a polyadenylation site, a translation initiation site, 5' or 3' untranslated regions, a reporter gene, a selectable marker or the like. The polynucleotide may comprise single stranded or double stranded DNA or RNA. The polynucleotide may comprise modified bases or a modified backbone. The polynucleotide may be genomic, an RNA transcript (such as an mRNA) or a processed nucleotide sequence (such as a cDNA). The polynucleotide may comprise a sequence in either sense or antisense orientations.

An isolated polynucleotide is a polynucleotide sequence that is not in its native state, e.g., the polynucleotide is comprised of a nucleotide sequence not found in nature or the polynucleotide is separated from nucleotide sequences with which it typically is in proximity or is next to nucleotide sequences with which it typically is not in proximity.

Recombinant nucleotide sequence refers to a nucleic acid molecule that contains a genetically engineered modification through manipulation via mutagenesis, restriction enzymes, and the like.

RNA interference (RNAi) refers to sequence-specific or gene-specific suppression of gene expression (protein synthesis) that is mediated by short interfering RNA (siRNA).

Sequence identity: as used herein, "sequence identity" or "identity" in the context of two nucleic acid sequences includes reference to the residues in the two sequences which are the same when aligned for maximum correspondence over a specified region.

As used herein, percentage of sequence identity means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base occurs in both sequences to yield the number of matched positions, dividing the number of matched positions by the total number of positions in the window of comparison and multiplying the result by 100 to yield the percentage of sequence identity.

"Sequence identity" has an art-recognized meaning and can be calculated using published techniques. See COMPUTATIONAL MOLECULAR BIOLOGY, Lesk, ed. (Oxford University Press, 1988), BIOCOMPUTING: INFORMATICS AND GENOME PROJECTS, Smith, ed. (Academic Press, 1993), COMPUTER ANALYSIS OF SEQUENCE DATA, PART I, Griffin & Griffin, eds., (Humana Press, 1994), SEQUENCE ANALYSIS IN MOLECULAR BIOLOGY, Von Heinje ed., Academic Press (1987), SEQUENCE ANALYSIS PRIMER, Gribskov & Devereux, eds. (Macmillan Stockton Press, 1991), and Carillo & Lipton, *SIAM J. Applied Math.* 48: 1073 (1988). Methods commonly employed to determine identity or similarity between two sequences include but are not limited to those disclosed in GUIDE TO HUGE COMPUTERS, Bishop, ed., (Academic Press, 1994) and Carillo & Lipton, supra. Methods to determine identity and similarity are codified in computer programs. Preferred computer program methods to determine identity and similarity between two sequences include but are not limited to the GCG program package (Devereux et al., *Nucleic Acids Research* 12: 387 (1984)), BLASTP, BLASTN, FASTA (Atschul et al., *J. Mol. Biol.* 215: 403 (1990)), and FASTDB (Brutlag et al., *Comp. App. Biosci.* 6: 237 (1990)).

Short hairpin RNA (shRNA) are short single-stranded RNAs having a high degree of secondary structure such that a portion of the RNA strand forms a hairpin loop.

Short interfering RNA (siRNA) refers to double-stranded RNA molecules from about 10 to about 30 nucleotides long that are named for their ability to specifically interfere with gene protein expression.

Target sequence refers to a nucleotide sequence in a pest that is selected for suppression or inhibition by double stranded RNA technology. A target sequence encodes an essential feature or biological activity within a pest.

Transcriptional terminators: The expression DNA constructs of the present invention typically have a transcriptional termination region at the opposite end from the transcription initiation regulatory region. The transcriptional termination region may be selected, for stability of the mRNA to enhance expression and/or for the addition of polyadenylation tails added to the gene transcription product. Translation of a nascent polypeptide undergoes termination when any of the three chain-termination codons enters the A site on the ribosome. Translation termination codons are UAA, UAG, and UGA.

Transformation: A process by which a nucleic acid is stably inserted into the genome of an organism. Transformation may occur under natural or artificial conditions using various methods well known in the art. Transformation may rely on any known method for the insertion of nucleic acid sequences into a prokaryotic or eukaryotic host cell, including microorganism-mediated transformation, viral infection, whiskers, electroporation, microinjection, polyethylene glycol-treatment, heat shock, lipofection, and particle bombardment.

Transgenic organism comprises at least one cell in which an exogenous nucleic acid has been stably integrated. A transgenic organism according to the invention is for instance a bacterial, or eukaryotic, such as a yeast, host cell or host organism. The bacterium can be chosen from the group comprising Gram-negative and Gram-positive bacteria, such as, but not limited to, *Escherichia* spp. (e.g. *E. coli*), *Bacillus* spp. (e.g. *B. thuringiensis*), *Rhizobium* spp., *Lactobacilllus* spp., *Lactococcus* spp., etc. The yeast can be chosen from the group comprising *Saccharomyces* spp., etc.

Variant: a "variant," as used herein, is understood to mean a nucleotide sequence that deviates from the standard, or given, nucleotide or amino acid sequence of a particular gene or protein. The terms, "isoform," "isotype," and "analog" also refer to "variant" forms of a nucleotide sequence. "Variant" may also refer to a "shuffled gene" such as those described in Maxygen-assigned patents.

It is understood that the present invention is not limited to the particular methodology, protocols, vectors, and reagents, etc., described herein, as these may vary. It is also to be understood that the terminology used herein is used for the purpose of describing particular embodiments only, and is not intended to limit the scope of the present invention. It must be noted that as used herein and in the appended claims, the singular forms "a," "an," and "the" include plural reference unless the context clearly dictates otherwise. Thus, for example, a reference to "a gene" is a reference to one or more genes and includes equivalents thereof known to those skilled in the art and so forth.

I. Target Pests

The present invention provides methodology and constructs for controlling pest infestations by administering, or otherwise exposing, to a pest a target coding sequence that post-transcriptionally represses or inhibits a requisite biological function in the pest. As used herein, the term "pest" refers to insects, arachnids, crustaceans, fungi, bacteria, viruses, nematodes, flatworms, roundworms, pinworms, hookworms, tapeworms, trypanosomes, schistosomes, botflies, fleas, ticks, mites, and lice and the like that are pervasive in the human environment. A pest may ingest or contact one or more cells, tissues, or products produced by an organism transformed with a double stranded gene suppression agent, as well as a surface or material treated with a double stranded gene suppression agent.

A "pest resistance" trait is a characteristic of a transgenic host that causes the host to be resistant to attack from a pest that typically inflicts damage to the host. Such pest resistance can arise from a natural mutation or more typically from incorporation of recombinant DNA that confers pest resistance. To impart pest resistance to a transgenic host, a recombinant DNA can, for example, be transcribed into a RNA molecule that forms a dsRNA molecule within the tissues or fluids of the recombinant host. The dsRNA molecule is comprised in part of a segment of RNA that is identical to a corresponding RNA segment encoded from a DNA sequence within a pest that prefers to feed on the recombinant host. Expression of the gene within the target pest is suppressed by the dsRNA, and the suppression of expression of the gene in the target pest results in the host being pest resistant.

Suitable pests include any organism that causes damage to another organism. The invention contemplates insect, nematode, and fungal pests in particular.

Insect as used herein can be any insect, meaning any organism belonging to the Kingdom Animals, more specific to the Phylum Arthropoda, and to the Class Insecta or the Class Arachnida. The methods of the invention are applicable to all insects and that are susceptible to gene silencing by RNA interference and that are capable of internalising double-stranded RNA from their immediate environment.

In one embodiment of the invention, the insect may belong to the following orders: Acari, Araneae, Anoplura, Coleoptera, Collembola, Dermaptera, Dictyoptera, Diplura, Diptera, Embioptera, Ephemeroptera, Grylloblatodea, Hemiptera, Homoptera, Hymenoptera, Isoptera, Lepidoptera, Mallophaga, Mecoptera, Neuroptera, Odonata, Orthoptera, Phasmida, Plecoptera, Protura, Psocoptera, Siphonaptera, Siphunculata, Thysanura, Strepsiptera, Thysanoptera, Trichoptera, and Zoraptera.

In preferred, but non-limiting, embodiments and methods of the invention the insect is chosen from the group consisting of:

(1) an insect which is a plant pest, such as but not limited to *Nilaparvata* spp. (e.g. *N. lugens* (brown planthopper)); *Laodelphax* spp. (e.g. *L. striatellus* (small brown planthopper)); *Nephotettix* spp. (e.g. *N. virescens* or *N. cincticeps* (green leafhopper), or *N. nigropictus* (rice leafhopper)); *Sogatella* spp. (e.g. *S. furcifera* (white-backed planthopper)); *Blissus* spp. (e.g. *B. leucopterus leucopterus* (chinch bug)); *Scotinophora* spp. (e.g. *S. vermidulate* (rice blackbug)); *Acrosternum* spp. (e.g. *A. hilare* (green stink bug)); *Parnara* spp. (e.g. *P. guttata* (rice skipper)); *Chilo* spp. (e.g. *C. suppressalis* (rice striped stem borer), *C. auricilius* (goldfringed stem borer), or *C. polychrysus* (dark-headed stem borer)); *Chilotraea* spp. (e.g. *C. polychrysa* (rice stalk borer)); *Sesamia* spp. (e.g. *S. inferens* (pink rice borer)); *Tryporyza* spp. (e.g. *T. innotata* (white rice borer), or *T. incertulas* (yellow rice borer)); *Cnaphalocrocis* spp. (e.g. *C. medinalis* (rice leafroller)); *Agromyza* spp. (e.g. *A. oryzae* (leafminer), or *A. parvicornis* (corn blot leafminer)); *Diatraea* spp. (e.g. *D. saccharalis* (sugarcane borer), or *D. grandiosella* (southwestern corn borer)); *Narnaga* spp. (e.g. *N. aenescens* (green rice caterpillar)); *Xanthodes* spp. (e.g. *X. transversa* (green caterpillar)); *Spodoptera* spp. (e.g. *S. frugiperda* (fall armyworm), *S. exigua* (beet armyworm), *S. littoralis* (climbing cutworm) or *S. praefica* (western yellowstriped armyworm)); *Mythimna* spp. (e.g. *Mythmna* (*Pseudaletia*) *seperata* (armyworm)); *Helicoverpa* spp. (e.g. *H. zea* (corn earworm)); *Colaspis* spp. (e.g. *C. brunnea* (grape *colaspis*)); *Lissorhoptrus* spp. (e.g. *L. oryzophilus* (rice water weevil)); *Echinocnemus* spp. (e.g. *E. squamos* (rice plant weevil)); *Diclodispa* spp. (e.g. *D. armigera* (rice hispa)); *Oulema* spp. (e.g. *O. oryzae* (leaf beetle); *Sitophilus* spp. (e.g. *S. oryzae* (rice weevil)); *Pachydiplosis* spp. (e.g. *P. oryzae* (rice gall midge)); *Hydrellia* spp. (e.g. *H. griseola* (small rice leafminer), or *H. sasakii* (rice stem maggot)); *Chlorops* spp. (e.g. *C. oryzae* (stem maggot)); *Ostrinia* spp. (e.g. *O. nubilalis* (European corn borer)); *Agrotis* spp. (e.g. *A. ipsilon* (black cutworm)); *Elasmopalpus* spp. (e.g. *E. lignosellus* (lesser cornstalk borer)); *Melanotus* spp. (wireworms); *Cyclocephala* spp. (e.g. *C. borealis* (northern masked chafer), or *C. immaculata* (southern masked chafer)); *Popillia* spp. (e.g. *P. japonica* (Japanese beetle)); *Chaetocnema* spp. (e.g. *C. pulicaria* (corn flea beetle)); *Sphenophorus* spp. (e.g. *S. maidis* (maize billbug)); *Rhopalosiphum* spp. (e.g. *R. maidis* (corn leaf aphid)); *Anuraphis* spp. (e.g. *A. maidiradicis* (corn root aphid)); *Melanoplus* spp. (e.g. *M. femurrubrum* (redlegged grasshopper) *M. differentialis* (differential grasshopper) or *M. sanguinipes* (migratory grasshopper)); *Hylemya* spp. (e.g. *H. platura* (seedcorn maggot)); *Anaphothrips* spp. (e.g. *A. obscrurus* (grass *thrips*)); *Solenopsis* spp. (e.g. *S. milesta* (thief ant)); or spp. (e.g. *T. urticae* (twospotted spider mite), *T. cinnabarinus* (carmine spider mite); *Helicoverpa* spp. (e.g. *H. zea* (cotton bollworm), or *H. armigera* (American bollworm)); *Pectinophora* spp. (e.g. *P. gossypiella* (pink bollworm)); *Earias* spp. (e.g. *E. vittella* (spotted bollworm)); *Heliothis* spp. (e.g. *H. virescens* (tobacco budworm)); *Anthonomus* spp. (e.g. *A. grandis* (boll weevil)); *Pseudatomoscelis* spp. (e.g. *P. seriatus* (cotton fleahopper)); *Trialeurodes* spp. (e.g. *T. abutiloneus* (banded-winged whitefly) *T. vaporariorum* (greenhouse whitefly)); *Bemisia* spp. (e.g. *B. argentifolii* (silverleaf whitefly)); *Aphis* spp. (e.g. *A. gossypii* (cotton aphid), *A. mellifera*); *Lygus* spp. (e.g. *L. lineolaris* (tarnished plant bug) or *L. hesperus* (western tarnished plant bug)); *Euschistus* spp. (e.g. *E. conspersus* (consperse stink bug)); *Chlorochroa* spp. (e.g. *C. sayi* (Say stinkbug)); *Nezara* spp. (e.g. *N. viridula* (southern green stinkbug)); *Thrips* spp. (e.g. *T. tabaci* (onion *thrips*)); *Frankliniella* spp. (e.g. *F. fusca* (tobacco *thrips*), or *F. occidentalis* (western flower *thrips*)); *Leptinotarsa* spp. (e.g. *L. decemlineata* (Colorado potato beetle), *L. juncta* (false potato beetle), or *L. texana* (Texan false potato beetle)); *Lema* spp. (e.g. *L. trilineata* (threelined potato beetle)); *Epitrix* spp. (e.g. *E. cucumeris* (potato flea beetle), *E. hirtipennis* (flea beetle), or *E. tuberis* (tuber flea beetle)); *Epicauta* spp. (e.g. *E. vittata* (striped blister beetle)); *Empoasca* spp. (e.g. *E. fabae* (potato leafhopper)); *Myzus* spp. (e.g. *M. persicae* (green peach aphid)); *Paratrioza* spp. (e.g. *P. cockerelli* (psyllid)); *Conoderus* spp. (e.g. *C. falli* (southern potato wireworm), or *C. vespertinus* (tobacco wireworm)); *Phthorimaea* spp. (e.g. *P. operculella* (potato tuberworm)); *Macrosiphum* spp. (e.g. *M. euphorbiae* (potato aphid)); *Thyanta* spp. (e.g. *T. pallidovirens* (red-shouldered stinkbug)); *Phthorimaea* spp. (e.g. *P. operculella* (potato tuberworm)); *Helicoverpa* spp. (e.g. *H. zea* (tomato fruitworm); *Keiferia* spp. (e.g. *K. lycopersicella* (tomato pinworm)); *Limonius* spp. (wireworms); *Manduca* spp. (e.g. *M. sexta* (tobacco hornworm), or *M. quinquemaculata* (tomato hornworm)); *Liriomyza* spp. (e.g. *L. sativae, L. trifolli* or *L. huidobrensis* (leafminer)); *Drosophilla* spp. (e.g. *D. melanogaster, D. yakuba, D. pseudoobscura* or *D. simulans*); *Carabus* spp. (e.g. *C. granulatus*); *Chironomus* spp. (e.g. *C. tentanus*); *Ctenocephalides* spp. (e.g. *C. felis* (cat flea)); *Diaprepes* spp. (e.g. *D. abbreviatus* (root weevil)); *Ips* spp. (e.g. *I. pini* (pine engraver)); *Tribolium* spp. (e.g. *T. castaneum* (red floor beetle)); *Glossina* spp. (e.g. *G. morsitans* (tsetse fly)); *Anopheles* spp. (e.g. *A. gambiae* (malaria mosquito)); *Helicoverpa* spp. (e.g. *H. armigera* (African Bollworm)); *Acyrthosiphon* spp. (e.g. *A. pisum* (pea aphid)); *Apis* spp. (e.g. *A. melifera* (honey bee)); *Homalodisca* spp. (e.g. *H. coagulate* (glassy-winged sharpshooter)); *Aedes* spp. (e.g. *Ae. aegypti* (yellow fever mosquito)); *Bombyx* spp. (e.g. *B. mori* (silkworm), *B. mandarina*); *Locusta* spp. (e.g. *L. migratoria* (migratory locust)); *Boophilus* spp. (e.g. *B. microplus* (cattle tick)); *Acanthoscurria* spp. (e.g. *A. gomesiana* (red-haired chololate bird eater)); *Diploptera* spp. (e.g. *D. punctata* (pacific beetle cockroach)); *Heliconius* spp. (e.g. *H. erato* (red passion flower butterfly) or *H. melpomene* (postman butterfly)); *Curculio* spp. (e.g. *C. glandium* (acorn weevil)); *Plutella* spp. (e.g. *P. xylostella* (diamontback moth)); *Amblyomma* spp. (e.g. *A. variegatum* (cattle tick)); *Anteraea* spp. (e.g. *A. yamamai* (silkmoth)); *Belgica* spp. (e.g. *B. antartica*), *Bemisa* spp. (e.g. *B. tabaci*), *Bicyclus* spp., *Biphillus* spp., *Callosobruchus* spp., *Choristoneura* spp., *Cicindela* spp., *Culex* spp., *Culicoides* spp., *Diaphorina* spp., *Diaprepes* spp., *Euclidia* spp., *Glossina* spp., *Gryllus* spp., *Hydropsyche* spp., *Julodis* spp., *Lonomia* spp., *Lutzomyia* spp., *Lysiphebus* spp, *Meladema* spp, *Mycetophagus* spp., *Nasonia* spp., *Oncometopia* spp., *Papilio* spp., *Pediculus* spp., *Plodia* spp., *Rhynchosciara* spp., *Sphaerius* spp., *Toxoptera* spp., *Trichoplusa* spp., and *Armigeres* spp. (e.g. *A. subalbatus*);

(2) an insect capable of infesting or injuring humans and/or animals such as, but not limited to those with piercing-sucking mouthparts, as found in Hemiptera and some Hymenoptera and Diptera such as mosquitoes, bees, wasps, lice, fleas and ants, as well as members of the Arachnidae such as ticks and mitesorder, class or family of Acarina (ticks and mites) e.g. representatives of the families Argasidae, Dermanyssidae, Ixodidae, Psoroptidae or Sarcoptidae and representatives of the species *Amblyomma* spp., *Anocentor* spp., *Argas* spp., *Boophilus* spp., *Cheyletiella* spp., *Chorioptes* spp., *Demodex* spp., *Dermacentor* spp., *Dermanyssus* spp., *Haemophysalis* spp., *Hyalomma* spp., *Ixodes* spp., *Lynxacurus* spp., *Mesostigmata* spp., *Notoedres* spp., *Ornithodoros* spp., *Ornithonyssus* spp., *Otobius* spp., *otodectes* spp., *Pneumonyssus* spp., *Psoroptes* spp., *Rhipicephalus* spp., *Sarcoptes* spp., or *Trombicula* spp.; Anoplura (sucking and biting lice) e.g. representatives of the species *Bovicola* spp., *Haematopinus* spp., *Linognathus* spp., *Menopon* spp., *Pediculus* spp., *Pemphigus* spp., *Phylloxera* spp., or *Solenopotes* spp.; Diptera (flies) e.g. representatives of the species *Aedes* spp., *Anopheles* spp., *Calliphora* spp., *Chrysomyia* spp., *Chrysops* spp., *Cochliomyia* spp., *Culex* spp., *Culicoides* spp., *Cuterebra* spp., *Dermatobia* spp., *Gastrophilus* spp., *Glossina* spp., *Haematobia* spp., *Haematopota* spp., *Hippobosca* spp., *Hypoderma* spp., *Lucilia* spp., *Lyperosia* spp., *Melophagus* spp., *Oestrus* spp., *Phaenicia* spp., *Phlebotomus* spp., *Phormia* spp., *Sarcophaga* spp., *Simulium* spp., *Stomoxys* spp., *Tabanus* spp., *Tannia* spp. or *Tipula* spp.; Mallophaga (biting lice) e.g. representatives of the species *Damalina* spp., *Felicola* spp., *Heterodoxus* spp. or *Trichodectes* spp.; or Siphonaptera (wingless insects) e.g. representatives of the species *Ceratophyllus* spp., spp., *Pulex* spp., or *Xenopsylla* spp; Cimicidae (true bugs) e.g. representatives of the species *Cimex* spp., *Tritominae* spp., *Rhodinius* spp., or *Triatoma* spp. and (3) an insect that causes unwanted damage to substrates or materials, such as insects that attack foodstuffs, seeds, wood, paint, plastic, clothing etc.

The methods of the invention are applicable to all nematodes and that are susceptible to gene silencing by RNA interference and that are capable of internalising double-stranded RNA from their immediate environment.

In one embodiment of the invention, the nematode may belong to the family of the Heteroderidae, encompassing the genera *Heterodera* and *Globodera*.

In preferred, but non-limiting, embodiments and methods of the invention the insect is chosen from the group comprising but not limited to:

(1) a nematode which is a plant pathogenic nematode, such as but not limited to: *Meloidogyne* spp. (e.g. *M. incognita, M. javanica, M. graminicola, M. arenaria, M. chitwoodi, M. hapla* or *M. paranaensis*); *Heterodera* spp. (e.g. *H. oryzae, H. glycines, H. zeae* or *H. schachtii*); *Globodera* spp. (e.g. *G. pallida* or *G. rostochiensis*); *Rotylenchulus* spp. (e.g. *R. reniformis*); *Pratylenchus* spp. (e.g. *P. coffeae, P. Zeae* or *P. goodeyi*); *Radopholus* spp. (e.g. *R. similis*); *Hirschmaniella* spp. (e.g. *H. oryzae*); *Ancylostoma* spp. (e.g. *A. caninum, A. ceylanicum, A. duodenale* or *A. tubaeforme*); Anisakid; *Aphelenchoides* spp. (e.g. *A. Besseyi*); Ascarids; *Ascaris* spp., (e.g. *A. suum* or *A. lumbridoides*); *Belonolaimus* spp.; *Brugia* spp. (e.g. *B. malayi* or *B. pahangi*); *Bursaphelenchus* spp.; *Caenorhabditis* spp. (e.g. *C. elegans, C. briggsae* or *C. remanei*); *Clostridium* spp. (e.g. *C. acetobutylicum*); *Cooperia* spp. (e.g. *C. oncophora*); *Criconemoides* spp.; *Cyathostomum* spp. (e.g. *C. catinatum, C. coronatum* or *C. pateratum*); *Cylicocyclus* spp. (e.g. *C. insigne, C. nassatus* or *C. radiatus*); *Cylicostephanus* spp. (e.g. *C. goldi* or *C. longibursatus*); Diphyllobothrium; *Dirofilaria* spp. (e.g. *D. immitis*); *Ditylenchus* spp. (e.g. *D. dipsaci, D. destructor* or *D. Angustus*); *Enterobius* spp. (e.g. *E. vermicularis*); *Haemonchus* spp. (e.g. *H. contortus*); *Helicotylenchus* spp.; *Hoplolaimus* spp.; *Litomosoides* spp. (e.g. *L. sigmodontis*); *Longidorus* spp. (e.g. *L. macrosoma*); *Necator* spp. (e.g. *N. americanus*); *Nippostrongylus* spp. (e.g. *N. brasiliensis*); *Onchocerca* spp. (e.g. *O. volvulus*); *Ostertagia* spp. (e.g. *O. ostertagi*); *Parastrongyloides* spp. (e.g. *P. trichosuri*); *Paratrichodorus* spp. (e.g. *P. minor* or *P. teres*); *Parelaphostrongylus* spp. (e.g. *P. tenuis*); *Radophulus* spp.; *Scutellonerna.* spp.; *Strongyloides* spp. (e.g. *S. Ratti* or *S. stercoralis*); *Teladorsagia* spp. (e.g. *T. circumcincta*); *Toxascaris* spp. (e.g. *T. leonina*); *Toxocara* spp. (e.g. *T. canis* or *T. cati*); *Trichinella* spp. (e.g. *T. britovi, T. spiralis* or *T. spirae*); *Trichodorus* spp. (e.g. *T. similis*); *Trichuris* spp. (e.g. *T. muris, T. vulpis* or *T. trichiura*); *Tylenchulus* spp.; *Tylenchorhynchus* spp.; *Uncinaria* spp. (e.g. *U. stenocephala*); *Wuchereria* spp. (e.g. *W. bancrofti*); *Xiphinema* spp. (e.g. *X. Index* or *X. americanum*).

(2) a nematode capable of infesting humans such as, but not limited to: *Enterobius vermicularis*, the pinworm that causes enterobiasis; *Ascaris lumbridoides*, the large intestinal roundworm that causes *ascariasis; Necator* and *Ancylostoma*, two types of hookworms that cause ancylostomiasis; *Trichuris trichiura*, the whipworm that causes trichuriasis; *Strongyloides stercoralis* that causes strongyloidiasis; and *Trichonella spirae* that causes trichinosis; *Brugia malayi* and *Wuchereria bancrofti*, the filarial nematodes associated with the worm infections known as lymphatic filariasis and its gross manifestation, elephantiasis, and *Onchocerca volvulus* that causes river blindness. Transfer of nematodes to humans may also occur through blood-feeding mosquitoes which have fed upon infected animals or humans;

(3) a nematode capable of infesting animals such as, but not limited to: dogs (Hookworms e.g. *Ancylostoma caninum* or *Uncinaria stenocephala*, Ascarids e.g. *Toxocara canis* or *Toxascaris leonina*, or Whipworms e.g. *Trichuris vulpis*), cats (Hookworms e.g. *Ancylostoma tubaeforme*, Ascarids e.g. *Toxocara cati*), fish (herring worms or cod worms e.g. *Anisakid*, or tapeworm e.g. *Diphyllobothrium*), sheep (Wire worms e.g. *Haemonchus contortus*) and cattle (Gastrointestinal worms e.g. *Ostertagia ostertagi, Cooperia oncophora*);

(4) a nematode that causes unwanted damage to substrates or materials, such as nematodes that attack foodstuffs, seeds, wood, paint, plastic, clothing etc. Examples of such nematodes include but are not limited to *Meloidogyne* spp. (e.g. *M. incognita, M. javanica, M. arenaria, M. graminicola, M. chitwoodi* or *M. hapla*); *Heterodera* spp. (e.g. *H. oryzae, H. glycines, H. zeae* or *H. schachtii*); *Globodera* spp. (e.g. *G. pallida* or *G. rostochiensis*); *Ditylenchus* spp. (e.g. *D. dipsaci, D. destructor* or *D. angustus*); *Belonolaimus* spp.; *Rotylenchulus* spp. (e.g. *R. reniformis*); *Pratylenchus* spp. (e.g. *P. coffeae, P. goodeyi* or *P. zeae*); *Radopholus* spp. (e.g. *R. Similis*); *Hirschmaniella* spp. (e.g. *H. oryzae*); *Aphelenchoides* spp. (e.g. *A. besseyi*); *Criconemoides* spp.; *Longidorus* spp.; *Helicotylenchus* spp.; *Hoplolaimus* spp.; *Xiphinema* spp.; *Paratrichodorus* spp. (e.g. *P. minor*); *Tylenchorhynchus* spp;

(5) virus transmitting nematodes (e.g. *Longidorus macrosoma*: transmits prunus necrotic ring spot virus, *Xiphinema americanum*: transmits tobacco ring spot virus, *Paratrichadorus teres*: transmits pea early browning virus, or *Trichodorus similis*: transmits tobacco rattle virus).

Fungal pests of particular interest include but are not limited to the following. In one embodiment of the invention, the fungus may be a mold, or more particularly a filamentous fungus. In other embodiments of the invention, the fungus may be a yeast.

In one embodiment the fungus may be an ascomycetes fungus, i.e. a fungus belonging to the Phylum *Ascomycota*.

In preferred, but non-limiting, embodiments of the invention the fungal cell is chosen from the group consisting of:

(1) a fungal cell of, or a cell derived from a plant pathogenic fungus, such as but not limited to *Acremoniella* spp., *Alternaria* spp. (e.g. *Alternaria brassicola* or *Alternaria solani*), *Ascochyta* spp. (e.g. *Ascochyta pisi*), *Botrytis* spp. (e.g. *Botrytis cinerea* or *Botryotinia fuckeliana*), *Cladosporium* spp., *Cercospora* spp. (e.g. *Cercospora kikuchii* or *Cercospora zaea-maydis*), *Cladosporium* spp. (e.g. *Cladosporium fulvum*), *Colletotrichum* spp. (e.g. *Colletotrichum lindemuthianum*), *Curvularia* spp., *Diplodia* spp. (e.g. *Diplodia maydis*), *Erysiphe* spp. (e.g. *Erysiphe graminis* f. sp. *graminis, Erysiphe graminis* f. sp. *hordei* or *Erysiphe pisi*), *Erwinia armylovora, Fusarium* spp. (e.g. *Fusarium nivale, Fusarium sporotrichioides, Fusarium oxysporum, Fusarium graminearum, Fusarium germinearum, Fusarium culmorum, Fusarium solani, Fusarium moniliforme* or *Fusarium roseum*), *Gaeumanomyces* spp. (e.g. *Gaeumanomyces graminis* f. sp. *tritici*), *Gibberella* spp. (e.g. *Gibberella zeae*), *Helminthosporium* spp. (e.g. *Helminthosporium turcicum, Helminthosporium carbonum, Helminthosporium mavdis* or *Helminthosporium sigmoideum*), *Leptosphaeria salvinii, Macrophomina* spp. (e.g. *Macrophomina phaseolina*), *Magnaportha* spp. (e.g. *Magnaporthe oryzae*), *Mycosphaerella* spp., *Nectria* spp. (e.g. *Nectria heamatococca*), *Peronospora* spp. (e.g. *Peronospora manshurica* or *Peronospora tabacina*), *Phoma* spp. (e.g. *Phoma betae*), *Phakopsora* spp. (e.g. *Phakopsora pachyrhizi*), *Phymatotrichum* spp. (e.g. *Phymatotrichum omnivorum*), *Phytophthora* spp. (e.g. *Phytophthora cinnamomi, Phytophthora cactorum, Phytophthora phaseoli, Phytophthora parasitica, Phytophthora citrophthora, Phytophthora megasperma* f. sp. *soiae* or *Phytophthora infestans*), *Plasmopara* spp. (e.g. *Plasmopara viticola*), *Podosphaera* spp. (e.g. *Podosphaera leucotricha*), *Puccinia* spp. (e.g. *Puccinia sorghi, Puccinia striiformis, Puccinia graminis* f. sp. *tritici, Puccinia asparagi, Puccinia recondite* or *Puccinia arachidis*), *Pythium* spp. (e.g. *Pythium aphanidermatum*), *Pyrenophora* spp. (e.g. *Pyrenophora tritici-repentens* or *Pyrenophora teres*), *Pyricularia* spp. (e.g. *Pyricularia oryzae*), *Pythium* spp. (e.g. *Pythium ultimum*), *Rhincosporium secalis, Rhizoctonia* spp. (e.g. *Rhizoctonia solani, Rhizoctonia oryzae* or *Rhizoctonia cerealis*), *Rhizopus* spp. (e.g. *Rhizopus chinensid*), *Scerotium* spp. (e.g. *Scerotium rolfsil*), *Sclerotinia* spp. (e.g. *Sclerotinia sclerotiorum*), *Septoria* spp. (e.g. *Septoria lycopersici, Septoria glycines, Septoria nodorum* or *Septoria tritici*), *Thielaviopsis* spp. (e.g. *Thielaviopsis basicola*), *Tilletia* spp., *Trichoderma* spp. (e.g. *Trichoderma virde*), *Uncinula* spp. (e.g. *Uncinula necator*), *Ustilago maydis* (e.g. corn smut), *Venturia* spp. (e.g. *Venturia inaequalis* or *Venturia pirina*) or *Verticillium* spp. (e.g. *Verticillium dahliae* or *Verticillium albo-atrum*);

(2) a fungal cell of, or a cell derived from a fungus capable of infesting humans such as, but not limited to, *Candida* spp., particularly *Candida albicans*; Dermatophytes including *Epidermophyton* spp., *Trichophyton* spp, and *Microsporum* spp.; *Aspergillus* spp. (particularly *Aspergillus flavus, Aspergillus fumigatus, Aspergillus nidulans, Aspergillus niger* or *Aspergillus terreus*); *Blastomyces dermatitidis; Paracoccidioides brasiliensis; Coccidioides immitis; Cryptococcus neoformans; Histoplasma capsulatum* Var. *capsulatum* or Var. *duboisii; Sporothrix schenckii; Fusarium* spp.; *Scopulariopsis brevicaulis; Fonsecaea* spp.; *Penicillium* spp.; or *Zygomycetes* group of fungi (particularly *Absidia corymbifera, Rhizomucor pusillus* or *Rhizopus arrhizus*);

(3) a fungal cell of, or a cell derived from a fungus capable of infesting animals such as, but not limited to *Candida* spp., *Microsporum* spp. (particularly *Microsporum canis* or *Microsporum gypseum*), *Trichophyton mentagrophytes, Aspergillus* spp., or *Cryptococcus neoforman;* and (4) a fungal cell of, or a cell derived from a fungus that causes unwanted damage to substrates or materials, such as fungi that attack foodstuffs, seeds, wood, paint, plastic, clothing etc. Examples of such fungi are the moulds, including but not limited to *Stachybotrys* spp., *Aspergillus* spp., *Alternaria* spp., *Cladosporium* spp., *Penicillium* spp. or *Phanerochaete chrysosporium*.

II. Identification of Target Sequences

The present invention provides a method for identifying and obtaining a nucleic acid comprising a nucleotide sequence for producing a dsRNA or siRNA. For example, such a method comprises: (a) probing a cDNA or genomic DNA library with a hybridization probe comprising all or a portion of a nucleotide sequence or a homolog thereof from a targeted pest; (b) identifying a DNA clone that hybridizes with the hybridization probe; (c) isolating the DNA clone identified in step (b); and (d) sequencing the cDNA or genomic DNA fragment that comprises the clone isolated in step (c) wherein the sequenced nucleic acid molecule transcribes all or a substantial portion of the RNA nucleotide acid sequence or a homolog thereof.

Additionally, the present invention contemplates a method for obtaining a nucleic acid fragment comprising a nucleotide sequence for producing a substantial portion of a dsRNA or siRNA comprising: (a) synthesizing first and a second oligonucleotide primers corresponding to a portion of one of the nucleotide sequences from a targeted pest; and (b) amplifying a cDNA or genomic DNA template in a cloning vector using the first and second oligonucleotide primers of step (a) wherein the amplified nucleic acid molecule transcribes a substantial portion of a dsRNA or siRNA of the present invention.

In practicing the present invention, a target gene may be derived from any pest that causes damage to another organism. Several criteria may be employed in the selection of preferred target genes. The gene is one whose protein product has a rapid turnover rate, so that dsRNA inhibition will result in a rapid decrease in protein levels. In certain embodiments it is advantageous to select a gene for which a small drop in expression level results in deleterious effects for the recipient pest. If it is desired to target a broad range of insect species, for example, a gene is selected that is highly conserved across these species. Conversely, for the purpose of conferring specificity, in certain embodiments of the invention, a gene is selected that contains regions that are poorly conserved between individual insect species, or between insects and other organisms. In certain embodiments it may be desirable to select a gene that has no known homologs in other organisms.

As used herein, the term "derived from" refers to a specified nucleotide sequence that may be obtained from a particular specified source or species, albeit not necessarily directly from that specified source or species.

In one embodiment, a gene is selected that is expressed in the insect gut. Targeting genes expressed in the gut avoids the requirement for the dsRNA to spread within the insect. Target genes for use in the present invention may include, for example, those that share substantial homologies to the nucleotide sequences of known gut-expressed genes that encode protein components of the plasma membrane proton V-ATPase (Dow et al., 1997; Dow, 1999). This protein complex is the sole energizer of epithelial ion transport and is responsible for alkalinization of the midgut lumen. The V-ATPase is also expressed in the Malpighian tubule, an outgrowth of the insect hindgut that functions in fluid balance and detoxification of foreign compounds in a manner analogous to a kidney organ of a mammal.

In another embodiment, a gene is selected that is essentially involved in the growth, development, and reproduction of an insect. Exemplary genes include but are not limited to the structural subunits of ribosomal proteins and a beta-coatamer gene, CHD3 gene. Ribosomal proteins such as S4 (RpS4) and S9(RpS9) are structural constituents of the ribosome involved in protein biosynthesis and which are components of the cytosolic small ribosomal subunit, the ribosomal proteins such as L9 and L19 are structural constituent of ribosome involved in protein biosynthesis which is localised to the ribosome. The beta-coatamer gene in *C. elegans* encodes a protein which is a subunit of a multimeric complex that forms a membrane vesicle coat Similar sequences have been found in diverse organisms such as *Arabidopsis thaliana, Drosophila melanogaster*, and *Saccharomyces cerevisiae*. Related sequences are found in diverse organisms such as *Leptinotarsa decemlineata, Phaedon cochleariae, Epilachna varivetis, Anthonomus grandis, Tribolium castaneum, Myzus persicae, Nilaparvata lugens, Chilo suppressalis, Plutella xylostella* and *Acheta domesticus*. Other target genes for use in the present invention may include, for example, those that play important roles in viability, growth, development, reproduction, and infectivity. These target genes include, for example, house keeping genes, transcription factors, and insect specific genes or lethal knockout mutations in *Caenorhabditis* or *Drosophila*. The target genes for use in the present invention may also be those that are from other organisms, e.g., from a nematode (e.g., *Meloidogyne* spp. or *Heterodera* spp.), other insects or arachnidae (e.g. *Leptinotarsa* spp., *Phaedon* spp., *Epilachna* spp., *Anthonomus* spp., *Tribolium* spp., *Myzus* spp., *Nilaparvata* spp., *Chilo* spp., *Plutella* spp., or *Acheta* spp. Additionally, the nucleotide sequences for use as a target sequence in the present invention may also be derived from viral, bacterial, fungal, insect or fungal genes whose functions have been established from literature and the nucleotide sequences of which share substantial similarity with the target genes in the genome of an insect.

For many of the insects that are potential targets for control by the present invention, there may be limited information regarding the sequences of most genes or the phenotype resulting from mutation of particular genes. Therefore, genes may be selected based on available information available concerning corresponding genes in a model organism, such as *Caenorhabditis* or *Drosophila*, or in some other insect species. Genes may also be selected based on available sequence information for other species, such as nematode or fungal species, in which the genes have been characterized. In some cases it will be possible to obtain the sequence of a corresponding gene from a target insect by searching databases, such as GenBank, using either the name of the gene or the gene sequence. Once the sequence is obtained, PCR may be used to amplify an appropriately selected segment of the gene in the insect for use in the present invention.

In order to obtain a DNA segment from the corresponding gene in an insect species, for example, PCR primers may be designed based on the sequence as found in *C. elegans* or *Drosophila*, or an insect from which the gene has already been cloned. The primers are designed to amplify a DNA segment of sufficient length for use in the present invention. Amplification conditions are selected so that amplification will occur even if the primers do not exactly match the target sequence. Alternately, the gene, or a portion thereof, may be cloned from a genomic DNA or cDNA library prepared from the insect pest species, using a known insect gene as a probe. Techniques for performing PCR and cloning from libraries are known. Further details of the process by which DNA segments from target insect pest species may be isolated based on the sequence of genes previously cloned from an insect species are provided in the Examples. One of ordinary skill in the art will recognize that a variety of techniques may be used to isolate gene segments from insect pest species that correspond to genes previously isolated from other species.

III. Methods for Inhibiting or Suppressing a Target Gene

The present invention provides methods for inhibiting gene expression of one or multiple target genes in a target pest using stabilized dsRNA methods. The invention is particularly useful for modulating eukaryotic gene expression, in particular modulating the expression of genes present in pests that exhibit a digestive system pH level that is from about 4.5 to about 9.5, more preferably from about 5.0 to about 8.0, and even more preferably from about 6.5 to about 7.5. For pests with a digestive system that exhibits pH levels outside of these ranges, delivery methods may be desired for use that do not require ingestion of dsRNA molecules.

The methods of the invention encompass the simultaneous or sequential provision of two or more different double-stranded RNAs or RNA constructs to the same insect, so as to achieve down-regulation or inhibition of multiple target genes or to achieve a more potent inhibition of a single target gene.

Alternatively, multiple targets are hit by the provision of one double-stranded RNA that hits multiple target sequences, and a single target is more efficiently inhibited by the presence of more than one copy of the double stranded RNA fragment corresponding to the target gene. Thus, in one embodiment of the invention, the double-stranded RNA construct comprises multiple dsRNA regions, at least one strand of each dsRNA region comprising a nucleotide sequence that is complementary to at least part of a target nucleotide sequence of an insect target gene. According to the invention, the dsRNA regions in the RNA construct may be complementary to the same or to different target genes and/or the dsRNA regions may be complementary to targets from the same or from different insect species. Use of such dsRNA constructs in a plant host cell, thus establishes a more potent resistance to a single or to multiple insect species in the plant. In one embodiment, the double stranded RNA region comprises multiple copies of the nucleotide sequence that is complementary to the target gene. Alternatively, the dsRNA hits more than one target sequence of the same target gene. The invention thus encompasses isolated double stranded RNA constructs comprising at least two copies of said nucleotide sequence complementary to at least part of a nucleotide sequence of an insect target. DsRNA that hits more than one of the above-mentioned targets, or a combination of different dsRNA against different of the above mentioned targets are developed and used in the methods of the present invention. Suitable dsRNA nucleotides and dsRNA constructs are described in WO2006/046148 by applicant, which is incorporated herein in its entirety.

The terms "hit", "hits", and "hitting" are alternative wordings to indicate that at least one of the strands of the dsRNA is complementary to, and as such may bind to, the target gene or nucleotide sequence.

The modulatory effect of dsRNA is applicable to a variety of genes expressed in the pests including, for example, endogenous genes responsible for cellular metabolism or cellular transformation, including house keeping genes, transcription factors, and other genes which encode polypeptides involved in cellular metabolism.

As used herein, the phrase "inhibition of gene expression" or "inhibiting expression of a target gene in the cell of an pest" refers to the absence (or observable decrease) in the level of protein and/or mRNA product from the target gene. Specificity refers to the ability to inhibit the target gene without manifest effects on other genes of the cell and without any effects on any gene within the cell that is producing the dsRNA molecule. The inhibition of gene expression of the target gene in the pest may result in novel phenotypic traits in the pest.

"Gene suppression" refers to any of the well-known methods for reducing the levels of gene transcription to mRNA and/or subsequent translation of the mRNA. Gene suppression is also intended to mean the reduction of protein expression from a gene or a coding sequence including posttranscriptional gene suppression and transcriptional suppression. Posttranscriptional gene suppression is mediated by the homology between of all or a part of a mRNA transcribed from a gene or coding sequence targeted for suppression and the corresponding double stranded RNA used for suppression, and refers to the substantial and measurable reduction of the amount of available mRNA available in the cell for binding by ribosomes. The transcribed RNA can be in the sense orientation to effect what is called co-suppression, in the anti-sense orientation to effect what is called anti-sense suppression, or in both orientations producing a dsRNA to effect what is called RNA interference (RNAi).

Transcriptional suppression is mediated by the presence in the cell of a dsRNA gene suppression agent exhibiting substantial sequence identity to a promoter DNA sequence or the complement thereof to effect what is referred to as promoter trans suppression. Gene suppression may be effective against a native host gene associated with a trait, e.g., to provide hosts with reduced levels of a protein encoded by the native gene or with enhanced or reduced levels of an affected metabolite. Gene suppression can also be effective against target genes in pests that may ingest or contact material containing gene suppression agents, specifically designed to inhibit or suppress the expression of one or more homologous or complementary sequences in the cells of the pest.

A beneficial method of post transcriptional gene suppression in hosts employs both sense-oriented and anti-sense-oriented, transcribed RNA which is stabilized, e.g., as a hairpin and stem and loop structure. A preferred DNA construct for effecting post transcriptional gene suppression is one in which a first segment encodes an RNA exhibiting an anti-sense orientation exhibiting substantial identity to a segment of a gene targeted for suppression, which is linked to a second segment in sense orientation encoding an RNA exhibiting substantial complementarity to the first segment. Such a construct forms a stem and loop structure by hybridization of the first segment with the second segment and a loop structure from the nucleotide sequences linking the two segments (see WO94/01550, WO98/05770, US 2002/0048814, and US 2003/0018993).

According to one embodiment of the present invention, there is provided a nucleotide sequence, for which in vitro expression results in transcription of a stabilized RNA sequence that is substantially homologous to an RNA molecule of a targeted gene in a pest that comprises an RNA sequence encoded by a nucleotide sequence within the genome of the pest. Thus, after the pest uptakes the stabilized RNA sequence, or is otherwise exposed to the dsRNA, a down-regulation of the nucleotide sequence corresponding to the target gene in the cells of a target pest is affected.

Inhibition of a target gene using the stabilized dsRNA technology of the present invention is sequence-specific in that nucleotide sequences corresponding to the duplex region of the RNA are targeted for genetic inhibition. RNA containing a nucleotide sequences identical to a portion of the target gene is preferred for inhibition. RNA sequences with insertions, deletions, and single point mutations relative to the target sequence have also been found to be effective for inhibition. In performance of the present invention, it is preferred that the inhibitory dsRNA and the portion of the target gene share at least from about 80% sequence identity, or from about 85% sequence identity, or from about 90% sequence identity, or from about 95% sequence identity, or from about 99% sequence identity, or even about 100% sequence identity. Alternatively, the duplex region of the RNA may be defined functionally as a nucleotide sequence that is capable of hybridizing with a portion of the target gene transcript. A less than full length sequence exhibiting a greater homology compensates for a longer less homologous sequence. The length of the identical nucleotide sequences may be at least about 25, 50, 100, 200, 300, 400, 500 or at least about 1000 bases. Normally, a sequence of greater than 20-100 nucleotides should be used, though a sequence of greater than about 200-300 nucleotides would be preferred, and a sequence of greater than about 500-1000 nucleotides would be especially preferred depending on the size of the target gene. The invention has the advantage of being able to tolerate sequence variations that might be expected due to genetic mutation, strain polymorphism, or evolutionary divergence. The introduced nucleic acid molecule may not need to be absolute homology, may not need to be full length, relative to either the primary transcription product or fully processed mRNA of the target gene. Therefore, those skilled in the art need to realize that, as disclosed herein, 100% sequence identity between the RNA and the target gene is not required to practice the present invention.

IV. Methods for Preparing dsRNA dsRNA molecules may be synthesized either in vivo or in vitro. The dsRNA may be formed by a single self-complementary RNA strand or from two complementary RNA strands. Endogenous RNA polymerase of the cell may mediate transcription in vivo, or cloned RNA polymerase can be used for transcription in vivo or in vitro Inhibition may be targeted by specific transcription in an organ, tissue, or cell type; stimulation of an environmental condition (e.g., infection, stress, temperature, chemical inducers); and/or engineering transcription at a developmental stage or age. The RNA strands may or may not be polyadenylated; the RNA strands may or may not be capable of being translated into a polypeptide by a cell's translational apparatus.

A RNA, dsRNA, siRNA, or miRNA of the present invention may be produced chemically or enzymatically by one skilled in the art through manual or automated reactions or in vivo in another organism. RNA may also be produced by partial or total organic synthesis; any modified ribonucleotide can be introduced by in vitro enzymatic or organic synthesis. The RNA may be synthesized by a cellular RNA polymerase or a bacteriophage RNA polymerase (e.g., T3, T7, SP6). The use and production of an expression construct are known in the art (see, for example, WO 97/32016; U.S. Pat. Nos. 5,593,874, 5,698,425, 5,712,135, 5,789,214, and 5,804,693). If synthesized chemically or by in vitro enzymatic synthesis, the RNA may be purified prior to introduction into the cell. For example, RNA can be purified from a mixture by extraction with a solvent or resin, precipitation, electrophoresis, chromatography, or a combination thereof. Alternatively, the RNA may be used with no or a minimum of purification to avoid losses due to sample processing. The RNA may be dried for storage or dissolved in an aqueous solution. The solution may contain buffers or salts to promote annealing, and/or stabilization of the duplex strands.

V. Polynucleotide Sequences

Provided according to the invention are nucleotide sequences, the expression of which results in an RNA sequence which is substantially homologous to an RNA molecule of a targeted gene in a pest that comprises an RNA sequence encoded by a nucleotide sequence within the genome of the pest. Thus, after ingestion of the dsRNA sequence down-regulation of the nucleotide sequence of the target gene in the cells of the pest may be obtained resulting in a deleterious effect on the maintenance, viability, proliferation, reproduction, and infestation of the pest.

Each "nucleotide sequence" set forth herein is presented as a sequence of deoxyribonucleotides (abbreviated A, G, C and T). However, by "nucleotide sequence" of a nucleic acid molecule or polynucleotide is intended, for a DNA molecule or polynucleotide, a sequence of deoxyribonucleotides, and for an RNA molecule or polynucleotide, the corresponding sequence of ribonucleotides (A, G, C and U) where each thymidine deoxynucleotide (T) in the specified deoxynucleotide sequence in is replaced by the ribonucleotide uridine (U).

As used herein, "nucleic acid" refers to a single or double-stranded polymer of deoxyribonucleotide or ribonucleotide bases read from the 5' to the 3' end. A nucleic acid may also optionally contain non-naturally occurring or altered nucleotide bases that permit correct read through by a polymerase and do not reduce expression of a polypeptide encoded by that nucleic acid. "Nucleotide sequence" or "nucleic acid sequence" refers to both the sense and anti-sense strands of a nucleic acid as either individual single strands or in the duplex.

The term "ribonucleic acid" (RNA) is inclusive of RNAi (inhibitory RNA), dsRNA (double stranded RNA), siRNA (small interfering RNA), mRNA (messenger RNA), miRNA (micro-RNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids.

The words "nucleic acid segment", "nucleotide sequence segment", or more generally "segment" will be understood by those in the art as a functional term that includes both genomic sequences, ribosomal RNA sequences, transfer RNA sequences, messenger RNA sequences, operon sequences and smaller engineered nucleotide sequences that express or may be adapted to express, proteins, polypeptides or peptides.

Accordingly, the present invention relates to an isolated nucleic molecule comprising a polynucleotide having a sequence selected from the group consisting of any of the polynucleotide sequences of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. The invention also provides functional fragments of the polynucleotide sequences of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. The invention further provides complementary nucleic acids, or fragments thereof, to any of the polynucleotide sequences of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481, as well as a nucleic acid, comprising at least 15 contiguous bases, which hybridizes to any of the polynucleotide sequences of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481.

The present invention also provides orthologous sequences, and complements and fragments thereof, of the polynucleotide sequences of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481 of the invention. Accordingly, the invention encompasses target genes which are insect orthologs of a gene comprising a nucleotide sequence as represented in any of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. By way of example, insect orthologues may comprise a nucleotide sequence as represented in any of SEQ ID NOs: 49-123, 275-434, 533-562, 621-738, 813-852, 908-1010, 1161-1437, 1730-1987, 2120-2290, 2384-2438, or a fragment thereof of at least 15, 16, 17, 18, 19, 20, 21, 22, 23, 24, 25, 26 or 27 nucleotides. A non-limiting list of insect or arachnida orthologs genes or sequences comprising at least a fragment of 15, preferably at least 17 bp of one of the sequences of the invention is given in Tables 4.

The invention also encompasses target genes which are nematode orthologs of a gene comprising a nucleotide sequence as represented in any of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476, and 2481 of the invention. By way of example, nematode orthologs may comprise a nucleotide sequence as represented in any of SEQ ID NOs: 124-135, 435-446, 563, 564, 739-751, 853, 854, 1011-1025, 1438-1473, 1988-2001, 2291-2298, 2439-2440 of the invention, or a fragment of at least 15, 16, 17, 18, 19, 20 or 21 nucleotides thereof. According to another aspect, the invention thus encompasses any of the methods described herein for controlling nematode growth in an organism, or for preventing nematode infestation of an organism susceptible to nemataode infection, comprising contacting nematode cells with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481, whereby the double-stranded RNA is taken up by the fungus and thereby controls growth or prevents infestation. The invention also relates to nematode-resistant transgenic plants comprising a fragment of at least 17, 18, 19, 20 or 21 nucleotides of any of the sequences as represented in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. A non-limiting list of nematode orthologs genes or sequences comprising at least a fragment of 15, preferably at least 17 bp of one of the sequences of the invention is given in Tables 5.

According to another embodiment, the invention encompasses target genes which are fungal orthologs of a gene comprising a nucleotide sequence as represented in any of SEQ ID Nos: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481 of the invention. By way of example, fungal orthologs may comprise a nucleotide sequence as represented in any of SEQ ID NOs:136-158, 447-472, 565-575, 752-767, 855-862, 1026-1040, 1474-1571, 2002-2039, 2299-2338, 2441-2460, or a fragment of at least 17, 18, 19, 20, 21, 22, 23, 24, 25, 26 or 27 nucleotides thereof. According to another aspect, the invention thus encompasses any of the methods described herein for controlling fungal growth on a cell or an organism, or for preventing fungal infestation of a cell or an organism susceptible to fungal infection, comprising contacting fungal cells with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481, whereby the double-stranded RNA is taken up by the fungus and thereby controls growth or prevents infestation. The invention also relates to fungal-resistant transgenic plants comprising a fragment of at least 17, 18, 19, 20 or 21 of any of the sequences as represented in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. A non-limiting list of fungal orthologs genes or sequences comprising at least a fragment of 15, preferably at least 17 bp of one of the sequences of the invention is given in Tables 6.

In a further embodiment, a dsRNA molecule of the invention comprises any of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481, though the sequences set forth in SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481 are not limiting. A dsRNA molecule of the invention can comprise any contiguous target gene from a pest species (e.g., about 15 to about 25 or more, or about 15, 16, 17, 18, 19, 20, 21, 22, 23, 24, or 25 or more contiguous nucleotides).

By "isolated" nucleic acid molecule(s) is intended a nucleic acid molecule, DNA or RNA, which has been removed from its native environment. For example, recombinant DNA molecules contained in a DNA construct are considered isolated for the purposes of the present invention. Further examples of isolated DNA molecules include recombinant DNA molecules maintained in heterologous host cells or purified (partially or substantially) DNA molecules in solution. Isolated RNA molecules include in vitro RNA transcripts of the DNA molecules of the present invention. Isolated nucleic acid molecules, according to the present invention, further include such molecules produced synthetically.

Nucleic acid molecules of the present invention may be in the form of RNA, such as mRNA, or in the form of DNA, including, for instance, cDNA and genomic DNA obtained by cloning or produced synthetically. The DNA or RNA may be double-stranded or single-stranded. Single-stranded DNA may be the coding strand, also known as the sense strand, or it may be the non-coding strand, also referred to as the anti-sense strand.

VI. Sequence Analysis

Unless otherwise indicated, all nucleotide sequences determined by sequencing a DNA molecule herein were determined using an automated DNA sequencer (such as the Model 373 from Applied Biosystems, Inc.). Therefore, as is known in the art for any DNA sequence determined by this automated approach, any nucleotide sequence determined herein may contain some errors. Nucleotide sequences determined by automation are typically at least about 95% identical, more typically at least about 96% to at least about 99.9% identical to the actual nucleotide sequence of the sequenced DNA molecule. The actual sequence can be more precisely determined by other approaches including manual DNA sequencing methods well known in the art. As is also known in the art, a single insertion or deletion in a determined nucleotide sequence compared to the actual sequence will cause a frame shift in translation of the nucleotide sequence such that the predicted amino acid sequence encoded by a determined nucleotide sequence may be completely different from the amino acid sequence actually encoded by the sequenced DNA molecule, beginning at the point of such an insertion or deletion.

In another aspect, the invention provides an isolated nucleic acid molecule comprising a polynucleotide which hybridizes under stringent hybridization conditions to a portion of the polynucleotide in a nucleic acid molecule of the invention described above. By a polynucleotide which hybridizes to a "portion" of a polynucleotide is intended a polynucleotide (either DNA or RNA) hybridizing to at least about 15 nucleotides, and more preferably at least about 20 nucleotides, and still more preferably at least about 30 nucleotides, and even more preferably more than 30 nucleotides of the reference polynucleotide. These fragments that hybridize to the reference fragments are useful as diagnostic probes and primers. For the purpose of the invention, two sequences hybridize when they form a double-stranded complex in a hybridization solution of 6×SSC, 0.5% SDS, 5×Denhardt's solution and 100 µg of non-specific carrier DNA. See Ausubel et al., section 2.9, supplement 27 (1994). Sequences may hybridize at "moderate stringency," which is defined as a temperature of 60° C. in a hybridization solution of 6×SSC, 0.5% SDS, 5×Denhardt's solution and 100 µg of non-specific carrier DNA. For "high stringency" hybridization, the temperature is increased to 68° C. Following the moderate stringency hybridization reaction, the nucleotides are washed in a solution of 2×SSC plus 0.05% SDS for five times at room temperature, with subsequent washes with 0.1×SSC plus 0.1% SDS at 60° C. for 1 h. For high stringency, the wash temperature is increased to 68° C. For the purpose of the invention, hybridized nucleotides are those that are detected using 1 ng of a radiolabeled probe having a specific radioactivity of 10,000 cpm/ng, where the hybridized nucleotides are clearly visible following exposure to X-ray film at −70° C. for no more than 72 hours.

The present application is directed to such nucleic acid molecules which are at least 60%, 65%, 70%, 75%, 80%, 85%, 90%, 95%, 96%, 97%, 98%, 99% or 100% identical to a nucleic acid sequence described in any of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. Preferred, however, are nucleic acid molecules which are at least 95%, 96%, 97%, 98%, 99% or 100% identical to the nucleic acid sequence shown in of SEQ ID NOs: 1, 3, 5, 7, 9, 11, 13, 15, 17, 19, 21, 23, 49-158, 159, 160, 163, 168, 173, 178, 183, 188, 193, 198, 203, 208, 215, 220, 225, 230, 247, 249, 251, 253, 255, 257, 259, 275-472, 473, 478, 483, 488, 493, 498, 503, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481. Differences between two nucleic acid sequences may occur at the 5' or 3' terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 95%, 96%, 97%, 98% or 99% identical to a reference nucleotide sequence refers to a comparison made between two molecules using standard algorithms well known in the art and can be determined conventionally using publicly available computer programs such as the BLASTN algorithm. See Altschul et al., *Nucleic Acids Res.* 25:3389-3402 (1997).

In one embodiment of the invention, a nucleic acid comprises an antisense strand having about 15 to about 30 (e.g., about 15, 16, 17, 18, 19, 20, 21, 22, 23, 24, 25, 26, 27, 28, 29, or 30) nucleotides, wherein the antisense strand is complementary to a RNA sequence or a portion thereof encoding a protein that controls cell cycle or homologous recombination, and wherein said siNA further comprises a sense strand having about 15 to about 30 (e.g., about 15, 16, 17, 18, 19, 20, 21, 22, 23, 24, 25, 26, 27, 28, 29, or 30) nucleotides, and wherein said sense strand and said antisense strand are distinct nucleotide sequences where at least about 15 nucleotides in each strand are complementary to the other strand.

In one embodiment, the present invention provides double-stranded nucleic acid molecules of that mediate RNA interference gene silencing. In another embodiment, the siNA molecules of the invention consist of duplex nucleic acid molecules containing about 15 to about 30 base pairs between oligonucleotides comprising about 15 to about 30 (e.g., about 15, 16, 17, 18, 19, 20, 21, 22, 23, 24, 25, 26, 27, 28, 29, or 30) nucleotides. In yet another embodiment, siNA molecules of the invention comprise duplex nucleic acid molecules with overhanging ends of about 1 to about 32 (e.g., about 1, 2, or 3) nucleotides, for example, about 21-nucleotide duplexes with about 19 base pairs and 3'-terminal mononucleotide, dinucleotide, or trinucleotide overhangs. In yet another embodiment, siNA molecules of the invention comprise duplex nucleic acid molecules with blunt ends, where both ends are blunt, or alternatively, where one of the ends is blunt.

An siNA molecule of the present invention may comprise modified nucleotides while maintaining the ability to mediate RNAi. The modified nucleotides can be used to improve in vitro or in vivo characteristics such as stability, activity, and/or bioavailability. For example, a siNA molecule of the invention can comprise modified nucleotides as a percentage of the total number of nucleotides present in the siNA molecule. As such, a siNA molecule of the invention can generally comprise about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given siNA molecule will depend on the total number of nucleotides present in the siNA. If the siNA molecule is single stranded, the percent modification can be based upon the total number of nucleotides present in the single stranded siNA molecules. Likewise, if the siNA molecule is double stranded, the percent modification can be based upon the total number of nucleotides present in the sense strand, antisense strand, or both the sense and antisense strands.

VII. Nucleic Acid Constructs

A recombinant nucleic acid vector may, for example, be a linear or a closed circular plasmid. The vector system may be a single vector or plasmid or two or more vectors or plasmids that together contain the total nucleic acid to be introduced into the genome of the bacterial host. In addition, a bacterial vector may be an expression vector. Nucleic acid molecules as set forth in SEQ ID NOs: 1, 3, 5, 7, 9, 11, 13, 15, 17, 19, 21, 23, 49-158, 159, 160, 161, 162, 163, 168, 173, 178, 183, 188, 193, 198, 203, 208, 215, 220, 225, 230, 240-246, 247, 249, 251, 253, 255, 257, 259, 275-472, 473, 478, 483, 488, 493, 498, 503, 508-512, 513, 515, 517, 519, 521, 533-575, 576, 581, 586, 591, 596, 601, 603, 605, 607, 609, 621-767, 768, 773, 778, 783, 788, 793, 795, 797, 799, 801, 813-862, 863, 868, 873, 878, 883, 888, 890, 892, 894, 896, 908-1040, 1041, 1046, 1051, 1056, 1061, 1066-1070, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161-1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730-2039, 2040, 2045, 2050, 2055, 2060, 2065, 2070, 2075, 2080, 2085, 2090, 2095, 2100, 2102, 2104, 2106, 2108, 2120-2338, 2339, 2344, 2349, 2354, 2359, 2364, 2366, 2368, 2370, 2372, 2384-2460, 2461, 2466, 2471, 2476 and 2481, or fragments thereof can, for example, be suitably inserted into a vector under the control of a suitable promoter that functions in one or more microbial hosts to drive expression of a linked coding sequence or other DNA sequence. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

Promoters

"Operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, and polyadenylation recognition sequences and the like.

An expression vector for producing a mRNA can also contain an inducible promoter that is recognized by the host bacterial organism and is operably linked to the nucleic acid encoding, for example, the nucleic acid molecule coding the *D. v. virgifera* mRNA or fragment thereof of interest. Inducible promoters suitable for use with bacterial hosts include β-lactamase promoter, *E. coli* λ phage PL and PR promoters, and *E. coli* galactose promoter, arabinose promoter, alkaline phosphatase promoter, tryptophan (trp) promoter, and the lactose operon promoter and variations thereof and hybrid promoters such as the tac promoter. However, other known bacterial inducible promoters are suitable.

In certain embodiments, the genes can be derived from different insects in order to broaden the range of insects against which the agent is effective. When multiple genes are targeted for suppression or a combination of expression and suppression, a polycistronic DNA element can be fabricated as illustrated and disclosed in Fillatti, Application Publication No. US 2004-0029283.

Selectable Marker Genes

A recombinant DNA vector or construct of the present invention will typically comprise a selectable marker that confers a selectable phenotype on transformed cells. Selectable markers may also be used to select for cells that contain the exogenous nucleic acids encoding polypeptides or proteins of the present invention. The marker may encode biocide resistance, such as antibiotic resistance (e.g., kanamycin, G418 bleomycin, hygromycin, etc.). Examples of selectable markers include, but are not limited to, a neo gene which codes for kanamycin resistance and can be selected for using kanamycin, G418, etc., a bar gene which codes for bialaphos resistance; a nitrilase gene which confers resistance to bromoxynil, and a methotrexate resistant DHFR gene. Examples of such selectable markers are illustrated in U.S. Pat. Nos. 5,550,318; 5,633,435; 5,780,708 and 6,118,047.

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson, 1987; Jefferson et al., 1987); a β-lactamase gene (Sutcliffe et al., 1978), a gene which encodes an enzyme for which various chromogenic substrates are known (e.g., PADAC, a chromogenic cephalosporin); a luciferase gene (Ow et al., 1986) a xylE gene (Zukowsky et al., 1983) which encodes a catechol dioxygenase that can convert chromogenic catechols; an α-amylase gene (Ikatu et al., 1990); a tyrosinase gene (Katz et al., 1983) which encodes an enzyme capable of oxidizing tyrosine to DOPA and dopaquinone which in turn condenses to melanin; an α-galactosidase, which catalyzes a chromogenic α-galactose substrate.

A transformation vector can be readily prepared using methods available in the art. The transformation vector comprises one or more nucleotide sequences that is/are capable of being transcribed to an RNA molecule and that is/are substantially homologous and/or complementary to one or more nucleotide sequences encoded by the genome of the insect, such that upon uptake of the RNA there is down-regulation of expression of at least one of the respective nucleotide sequences of the genome of the pest.

VIII. Methods for Genetic Engineering

The present invention contemplates introduction of a nucleotide sequence into a organism to achieve pest inhibitory levels of expression of one or more dsRNA molecules. The inventive polynucleotides and polypeptides may be introduced into a host cell, such as bacterial or yeast cell, by standard procedures known in the art for introducing recombinant sequences into a target host cell. Such procedures include, but are not limited to, transfection, infection, transformation, natural uptake, calcium phosphate, electroporation, microinjection biolistics and microorganism-mediated transformation protocols. The methods chosen vary with the host organism.

A transgenic organism of the present invention is one that comprises at least one cell it its genome in which an exogenous nucleic acid has been stably integrated. Thus, a transgenic organism may contain only genetically modified cells in certain parts of its structure.

Accordingly, the present invention also encompasses a transgenic cell or organism comprising any of the nucleotide sequences or recombinant DNA constructs described herein. The invention further encompasses prokaryotic cells (such as, but not limited to, gram-positive and gram-negative bacterial cells) and eukaryotic cells (such as, but not limited to, yeast cells or plant cells).

For example, the present invention contemplates introducing a target gene into a bacterium, such as *Lactobacillus*. The nucleic acid constructs can be integrated into a bacterial genome with an integrating vector. Integrating vectors typically contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP 0 127,328). Integrating vectors may also be comprised of bacteriophage or transposon sequences. Suicide vectors are also known in the art.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *D. v. virgifera* protein or fragment thereof, may be ligated into the vector in frame with sequences for the amino-terminal Met and the subsequent 7 residues of β-galactosidase so that a hybrid protein is produced; pIN vectors (Van Heeke and Schuster, 1989); and the like.

The invention also contemplates introducing a target gene into a yeast cell. A yeast recombinant construct can typically include one or more of the following: a promoter sequence, fusion partner sequence, leader sequence, transcription termination sequence, a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al., 1979), pCl/1 (Brake et al., 1984), and YRp17 (Stinchcomb et al., 1982). In addition, a replicon may be either a high or low copy number plasmid. A high copy number plasmid will generally have a copy number ranging from about 5 to about 200, and typically about 10 to about 150. A host containing a high copy number plasmid will preferably have at least about 10, and more preferably at least about 20.

Useful yeast promoter sequences can be derived from genes encoding enzymes in the metabolic pathway. Examples of such genes include alcohol dehydrogenase (ADH) (EP 0 284044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EP 0 3215447). The yeast PHO5 gene, encoding acid phosphatase, also provides useful promoter sequences (Myanohara et al., 1983). In addition, synthetic promoters that do not occur in nature also function as yeast promoters. Examples of such hybrid promoters include the ADH regulatory sequence linked to the GAP transcription activation region (U.S. Pat. Nos. 4,876,197 and 4,880,734). Examples of transcription terminator sequences and other yeast-recognized termination sequences, such as those coding for glycolytic enzymes, are known to those of skill in the art.

Alternatively, the expression constructs can be integrated into the yeast genome with an integrating vector. Integrating vectors typically contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al., 1983). An integrating vector may be directed to a specific locus in yeast by selecting the appropriate homologous sequence for inclusion in the vector. See Orr-Weaver et al., supra. One or more expression constructs may integrate, possibly affecting levels of recombinant protein produced (Rine et al., 1983).

IX. Quantifying Inhibition of Target Gene Expression

Inhibition of target gene expression may be quantified by measuring either the endogenous target RNA or the protein produced by translation of the target RNA and the consequences of inhibition can be confirmed by examination of the outward properties of the cell or organism. Techniques for quantifying RNA and proteins are well known to one of ordinary skill in the art. Multiple selectable markers are available that confer resistance to ampicillin, bleomycin, chloramphenicol, gentamycin, hygromycin, kanamycin, lincomycin, methotrexate, phosphinothricin, puromycin, spectinomycin, rifampicin, and tetracyclin, and the like.

In certain embodiments gene expression is inhibited by at least 10%, preferably by at least 33%, more preferably by at least 50%, and yet more preferably by at least 80%. In particularly preferred embodiments of the invention gene expression is inhibited by at least 80%, more preferably by at least 90%, more preferably by at least 95%, or by at least 99% within cells in the pest so a significant inhibition takes place. Significant inhibition is intended to refer to sufficient inhibition that results in a detectable phenotype (e.g., cessation of larval growth, paralysis or mortality, etc.) or a detectable decrease in RNA and/or protein corresponding to the target gene being inhibited. Although in certain embodiments of the invention inhibition occurs in substantially all cells of the pest, in other preferred embodiments inhibition occurs in only a subset of cells expressing the gene. For example, if the target gene plays an essential role in cells in an insect alimentary tract, inhibition of the gene within these cells is sufficient to exert a deleterious effect on the insect.

X. Exposing Pest to dsRNA

A pest can be exposed to a dsRNA in any suitable manner that permits administering the dsRNA to the pest. For example, the pest can be contacted with the dsRNA in pure or substantially pure form, for example an aqueous solution containing the dsRNA. In one embodiment, the insect may be simply "soaked" or "sprayed" with an aqueous solution comprising the dsRNA. Alternatively, the pest may be "sprayed" with a solution comprising a dsRNA.

Alternatively, the dsRNA may be linked to a food component of the pest, such as a food component for a mammalian pathogenic pest, in order to increase uptake of the dsRNA by the insect. Ingestion by a pest permits delivery of the pest control agents to the pest and results in down-regulation of a target gene in the host. Methods for oral introduction may include, for example, directly mixing dsRNA with a, pest's food, as well as engineered approaches in which a species that is used as food is engineered to express the dsRNA or siRNA, then fed to the pest to be affected. For example, a bacteria, such as *Lactobacillus*, may be transformed with a target sequence and then fed to a pest. In one embodiment, for example, the dsRNA or siRNA molecules may be incorporated into, or overlaid on the top of, the insect's diet.

In other embodiments the pest may be contacted with a composition containing the inventive dsRNA. The composition may, in addition to the dsRNA, contain further excipients, diluents, or carriers.

The dsRNA may also be incorporated in the medium in which the pest grows or infests. For example, a dsRNA may be incorporated into a food container or protective wrapping as a means for inhibiting pest infestation. Wood, for example, may be treated with a solution comprising a dsRNA to prevent pest infestation.

In other embodiments, the dsRNA is expressed in a bacterial or fungal cell and the bacterial or fungal cell is taken up or eaten by the insect species.

As illustrated in the examples, bacteria can be engineered to produce any of the dsRNA or dsRNA constructs of the invention. These bacteria can be eaten by the insect species. When taken up, the dsRNA can initiate an RNAi response, leading to the degradation of the target mRNA and weakening or killing of the feeding insect. Alternatively, dsRNA producing bacteria or yeast cells can be sprayed directly onto the crops.

Some bacteria have a very close interaction with the host plant, such as, but not limited to, symbiotic *Rhizobium* with the *Legminosea* (for example Soy). Such recombinant bacteria could be mixed with the seeds (for instance as a coating) and used as soil improvers.

A virus such as a baculovirus which specifically infects insects may be also be used. This ensures safety for mammals, especially humans, since the virus will not infect the mammal, so no unwanted RNAi effect will occur.

Possible applications include intensive greenhouse cultures, for instance crops that are less interesting from a GMO point of view, as well as broader field crops such as soy.

This approach has several advantages, eg: since the problem of possible dicing by a plant host is not present, it allows the delivery of large dsRNA fragments into the gut lumen of the feeding pest; the use of bacteria as insecticides does not involve the generation of transgenic crops, especially for certain crops where transgenic variants are difficult to obtain; there is a broad and flexible application in that different crops can be simultaneously treated on the same field and/or different pests can be simultaneously targeted, for instance by combining different bacteria producing distinct dsRNAs.

XI. Products

The present invention provides numerous products that can encompass a dsRNA for use in controlling pests. For example, the invention provides pharmaceutical or veterinary compositions for treating or preventing a pest disease or infection of humans or animals, respectively. Such compositions comprise at least one dsRNA or RNA construct, or nucleotide sequence or recombinant DNA construct encoding the dsRNA or RNA construct, or wherein the RNA comprises annealed complementary strands, one of which has a nucleotide sequence which corresponds to a target nucleotide sequence of an pest target gene that causes the disease or infection, and at least one carrier, excipient, or diluent suitable for pharmaceutical use.

Alternatively, a pharmaceutical or veterinary composition may be used as a composition suitable for topical use, such as application on the skin of an animal or human. For example, a dsRNA may be used in a liquid composition to be applied to the skin as drops, gel, aerosol, cream, ointment, etc. Additionally, a dsRNA may be integrated into a transdermal patch or other medical device for treating or preventing a disease or condition. Other conventional pharmaceutical dosage forms may also be produced, including tablets, capsules, pessaries, transdermal patches, suppositories, etc. The chosen form will depend upon the nature of the target pest and hence the nature of the disease it is desired to treat.

Oral vaccines, for example, can be produced using the inventive constructs and methods. For example, a vaccine can be constructed by producing a dsRNA in bacteria (e.g. *lactobacillus*) which can be included in food and functions as an oral vaccine against insect infection. Accordingly, the invention provides constructs and methods for treating and/or preventing a pest disease or condition, comprising administering to a subject in need of such treatment and/or prevention, any of the compositions as herein described, said composition comprising at least one double-stranded RNA or double stranded RNA construct comprising annealed complementary strands, one of which has a nucleotide sequence which is complementary to at least part of a nucleotide sequence of a pest target gene that causes the disease or condition.

While the inventive compositions may be used for treating a disease or condition in a subject patient, the compositions and methods may also be used as a means for protecting a substrate or material from pest infestation. The nature of the excipients included in the composition and the physical form of the composition may vary depending upon the nature of the substrate that it is desired to treat.

For example, such a composition may be a coating or a powder that can be applied to a substrate as a means for protecting the substrate from infestation by an insect and thereby preventing pest-induced damage to the substrate or material. Thus, in one embodiment, the composition is in the form of a coating on a suitable surface which adheres to, and is eventually ingested by an insect which comes into contact with the coating. Such a composition can be used to protect any substrate or material that is susceptible to infestation by or damage caused by a pest, for example foodstuffs and other perishable materials, and substrates such as wood.

For example, the composition may be a liquid that is brushed or sprayed onto or imprinted into the material or substrate to be treated. Thus, a human user can spray the insect or the substrate directly with the composition For example, houses and other wood products can be destroyed by termites, powder post beetles, and carpenter ants. By treating wood or house siding with a composition comprising a dsRNA, it may be possible to reduce pest infestation. Likewise, a tree trunk may be treated with a composition comprising a dsRNA.

Flour beetles, grain weevils, meal moths, and other pests feed on stored grain, cereals, pet food, powdered chocolate, and almost everything else in the kitchen pantry that is not protected. Accordingly, the present invention provides a means for treating cereal boxes and other food storage containers and wrapping with a composition comprising a target dsRNA.

Larvae of clothes moths eat clothes made from animal products, such as fur, silk and wool. Thus, it may be desirable to treat hangers, closet organizers, and garment bags with the inventive dsRNA. Book lice and silverfish are pests of libraries because they eat the starchy glue in the bindings of books. Accordingly, the present invention provides compositions for treating books from pest infestation and destruction.

In one embodiment, the composition is in the form of a bait. The bait is designed to lure the insect to come into contact with the composition. Upon coming into contact therewith, the composition is then internalized by the insect, by ingestion for example and mediates RNAi to thus kill the insect. The bait may depend on the species being targeted. An attractant may also be used. The attractant may be a pheromone, such as a male or female pheromone for example. The attractant acts to lure the insect to the bait, and may be targeted for a particular insect or may attract a whole range of insects. The bait may be in any suitable form, such as a solid, paste, pellet or powdered form.

The bait may also be carried away by the insect back to the colony. The bait may then act as a food source for other members of the colony, thus providing an effective control of a large number of insects and potentially an entire insect pest colony. This is an advantage associated with use of the double stranded RNA or bacteria expressing the dsRNA of the invention, because the delayed action of the RNAi mediated effects on the pests allows the bait to be carried back to the colony, thus delivering maximal impact in terms of exposure to the insects.

The baits may be provided in a suitable "housing" or "trap". Such housings and traps are commercially available and existing traps may be adapted to include the compositions of the invention. The housing or trap may be box-shaped for example, and may be provided in pre-formed condition or may be formed of foldable cardboard for example. Suitable materials for a housing or trap include plastics and cardboard, particularly corrugated cardboard. The inside surfaces of the traps may be lined with a sticky substance in order to restrict movement of the insect once inside the trap. The housing or trap may contain a suitable trough inside which can hold the bait in place. A trap is distinguished from a housing because the insect can not readily leave a trap following entry, whereas a housing acts as a "feeding station" which provides the insect arachnid with a preferred environment in which they can feed and feel safe from predators.

It is clear that numerous products and substrates can be treated with the inventive compositions for reducing pest infestation. Of course, the nature of the excipients and the physical form of the composition may vary depending upon the nature of the substrate that is desired to treat. For example, the composition may be a liquid that is brushed or sprayed onto or imprinted into the material or substrate to be treated, or a coating that is applied to the material or substrate to be treated.

Specific examples are presented below of methods for identifying target sequences and introducing the sequences into various cells and compositions. They are meant to be exemplary and not as limitations on the present invention.

Example 1: Silencing *C. elegans* Target Genes in *C. elegans* in High Throughput Screening A *C. elegans* genome wide library was prepared in the pGN9A vector (WO 01/88121) between two identical T7-promoters and terminators, driving its expression in the sense and antisense direction upon expression of the T7 polymerase, which was induced by IPTG.

This library was transformed into the bacterial strain AB301-105 (DE3) in 96 well plate format. For the genome wide screening, these bacterial cells were fed to the nuclease deficient *C. elegans* nuc-1 (e1392) strain.

Feeding the dsRNA produced in the bacterial strain AB301-105 (DE3), to *C. elegans* nuc-1 (e1392) worms, was performed in a 96 well plate format as follows: nuc-1 eggs were transferred to a separate plate and allowed to hatch simultaneously at 20° C. for synchronization of the L1 generation. 96 well plates were filled with 100 µL liquid growth medium comprising IPTG and with 10 µL bacterial cell culture of $OD_{600}1$ AB301-105 (DE3) of the *C. elegans* dsRNA library carrying each a vector with a *C. elegans* genomic fragment for expression of the dsRNA. To each well, 4 of the synchronized L1 worms were added and were incubated at 25° C. for at least 4 to 5 days. These experiments were performed in quadruplicate. In the screen 6 controls were used:

pGN29=negative control, wild type
pGZ1=unc-22=twitcher phenotype
pGZ18=chitin synthase=embryonic lethal
pGZ25=pos-1=embryonic lethal
pGZ59=bli-4D=acute lethal
ACC=acetyl co-enzyme A carboxylase=acute lethal After 5 days, the phenotype of the *C. elegans* nuc-1 (e1392) worms fed with the bacteria producing dsRNA were compared to the phenotype of worms fed with the empty vector (pGN29) and the other controls. The worms that were fed with the dsRNA were screened for lethality (acute or larval) lethality for the parent (Po) generation, (embryonic) lethality for the first filial (F1) generation, or for growth retardation of Po as follows: (i) Acute lethality of Po: L1's have not developed and are dead, this phenotype never gives progeny and the well looks quite empty; (ii) (Larval) lethality of Po: Po died in a later stage than L1, this phenotype also never gives progeny. Dead larvae or dead adult worms are found in the wells; (iii) Lethality for F1: L1's have developed until adult stage and are still alive. This phenotype has no progeny. This can be due to sterility, embryonic lethality (dead eggs on the bottom of well), embryonic arrest or larval arrest (eventually ends up being lethal): (iv) Arrested in growth and growth retardation/delay: Compared to a well with normal development and normal # of progeny.

For the target sequences presented in Table 1A, it was concluded that dsRNA mediated silencing of the *C. elegans* target gene in nematodes, such as *C. elegans*, had a fatal effect on the growth and viability of the worm.

Subsequent to the above dsRNA silencing experiment, a more detailed phenotyping experiment was conducted in *C. elegans* in a high throughput format on 24 well plates. The dsRNA library produced in bacterial strain AB301-105 (DE3), as described above, was fed to *C. elegans* nuc-1 (e1392) worms on 24 well plates as follows: nuc-1 eggs were transferred to a separate plate and allowed to hatch simultaneously at 20 C for synchronization of the L1 generation. Subsequently 100 of the synchronized L1 worms were soaked in a mixture of 500 µA S-complete fed medium, comprising 5 µg/mL cholesterol, 4 µL/mL PEG and 1 mM IPTG, and 500 µA of bacterial cell culture of $OD_{600}1$ AB301-105 (DE3) of the *C. elegans* dsRNA library carrying each a vector with a *C. elegans* genomic fragment for expression of the dsRNA. The soaked L1 worms were rolled for 2 hours at 25 C.

After centrifugation and removal of 950 µL of the supernatant, 5 µL of the remaining and resuspended pellet (comprising about 10 to 15 worms) was transferred in the middle of each well of a 24 well plate, filled with a layer of agar LB broth. The inoculated plate was incubated at 25° C. for 2 days. At the adult stage, 1 adult worm was singled and incubated at 25° C. for 2 days for inspection of its progeny. The other adult worms are inspected in situ on the original 24 well plate. These experiments were performed in quadruplicate.

This detailed phenotypic screen was repeated with a second batch of worms, the only difference being that the worms of the second batch were incubated at 20 C for 3 days.

The phenotype of the worms fed with *C. elegans* dsRNA was compared to the phenotype of *C. elegans* nuc-1 (e1392) worms fed with the empty vector.

Based on this experiment, it was concluded that silencing the *C. elegans* target genes as represented in Table 1A had a fatal effect on the growth and viability of the worm and that the target gene is essential to the viability of nematodes. Therefore these genes are good target genes to control (kill or prevent from growing) nematodes via dsRNA mediated gene silencing. Accordingly, the present invention encompasses the use of nematode orthologs of the above *C. elegans* target gene to control nematode infestation in a variety of organisms and materials.

Example 2: Identification of *D. melanogaster* Orthologs

As described above in Example 1, numerous *C. elegans* lethal sequences were identified and can be used for identifying orthologs in other species and genera. For example, the *C. elegans* lethal sequences can be used to identify orthologous *D. melanogasters* sequences. That is, each *C. elegans* sequence can be querried against a public database, such as GenBank, for orthologous sequences in *D. melanogaster*. Potential *D. melanogaster* orthologs were selected that share a high degree of sequence homology (E value preferably less than or equal to 1E-30) and the sequences are blast reciprocal best hits, the latter means that the sequences from different organisms (e.g. *C. elegans* and *D. melanogaster*) are each other's top blast hits. For example, sequence C from *C. elegans* is compared against sequences in *D. melanogaster* using BLAST. If sequence C has the *D. melanogaster* sequence D as best hit and when D is compared to all the sequences of *C. elegans*, also turns out to be sequence C, then D and C are reciprocal best hits. This criterium is often used to define orthology, meaning similar sequences of different species, having similar function. The *D. melanogaster* sequence identifiers are represented in Table 1A.

Example 3: *Leptinotarsa decemlineata* (Colorado Potato Beetle)

A. Cloning Partial Gene Sequences from *Leptinotarsa decemlineata*

High quality, intact RNA was isolated from 4 different larval stages of *Leptinotarsa decemlineata* (Colorado potato beetle; source: Jeroen van Schaik, Entocare CV Biologische Gewasbescherming, Postbus 162, 6700 AD Wageningen, the Netherlands) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the LD001, LD002, LD003, LD006, LD007, LD010, LD011, LD014, LD015, LD016 and LD018 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-LD, which displays *Leptintarsa decemlineata* target genes including primer sequences and cDNA sequences obtained. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen), and sequenced. The sequences of the resulting PCR products are represented by the respective SEQ ID NOs as given in Table 2-LD and are referred to as the partial sequences. The corresponding partial amino acid sequence are represented by the respective SEQ ID NOs as given in Table 3-LD, where the start of the reading frame is indicated in brackets.

B. dsRNA Production of the *Leptinotarsa decemlineata* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-LD. The conditions in the PCR reactions were as follows: 4 minutes at 95° C., followed by 35 cycles of 30 seconds at 95° C., 30 seconds at 55° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-LD. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-LD. Table 8-LD displays sequences for preparing ds RNA fragments of *Leptinotarsa decemlineata* target sequences and concatemer sequences, including primer sequences.

C. Screening dsRNA Targets Using Artificial Diet for Activity Against *Leptinotarsa decemlineata*

Artificial diet for the Colorado potato beetle was prepared as follows (adapted from Gelman et al., 2001, J. Ins. Sc., vol. 1, no. 7, 1-10): water and agar were autoclaved, and the remaining ingredients (shown in Table 2 below) were added when the temperature dropped to 55° C. At this temperature, the ingredients were mixed well before the diet was aliquoted into 24-well plates (Nunc) with a quantity of 1 ml of diet per well. The artificial diet was allowed to solidify by cooling at room temperature. Diet was stored at 4° C. for up to three weeks.

TABLE 2

Ingredients for Artificial diet

| Ingredients | Volume for 1 L |
|---|---|
| water | 768 ml |
| agar | 14 g |
| rolled oats | 40 g |
| Torula yeast | 60 g |
| lactalbumin hydrolysate | 30 g |
| casein | 10 g |
| fructose | 20 g |
| Wesson salt mixture | 4 g |
| tomato fruit powder | 12.5 g |
| potato leaf powder | 25 g |
| b-sitosterol | 1 g |
| sorbic acid | 0.8 g |
| methyl paraben | 0.8 g |
| Vanderzant vitamin mix | 12 g |
| neomycin sulfate | 0.2 g |
| aureomycin | 0.130 g |
| rifampicin | 0.130 g |

TABLE 2-continued

Ingredients for Artificial diet

| Ingredients | Volume for 1 L |
| --- | --- |
| chloramphenicol | 0.130 g |
| nystatin | 0.050 g |
| soybean oil | 2 ml |
| wheat germ oil | 2 ml |

Fifty μl of a solution of dsRNA at a concentration of 1 mg/ml was applied topically onto the solid artificial diet in the wells of the multiwell plate. The diet was dried in a laminair flow cabin. Per treatment, twenty-four Colorado potato beetle larvae ($2^{nd}$ stage), with two insects per well, were tested. The plates were stored in the insect rearing chamber at 25±2° C., 60% relative humidity, with a 16:8 hours light:dark photoperiod. The beetles were assessed as live or dead every 1, 2 or 3 days. After seven days, for targets LD006, LD007, LD010, LD011, and LD014, the diet was replaced with fresh diet with topically applied dsRNA at the same concentration (1 mg/ml); for targets LD001, LD002, LD003, LD015, and LD016, the diet was replaced with fresh diet only. The dsRNA targets were compared to diet only or diet with topically applied dsRNA corresponding to a fragment of the GFP (green fluorescent protein) coding sequence (SEQ ID NO: 235).

Feeding artificial diet containing intact naked dsRNAs to *L. decemlineata* larvae resulted in significant increases in larval mortalities as indicated in two separate bioassays (FIGS. 1LD-2LD).

All dsRNAs tested resulted ultimately in 100% mortality after 7 to 14 days. Diet with or without GFP dsRNA sustained the insects throughout the bioassays with very little or no mortality.

Typically, in all assays observed, CPB second-stage larvae fed normally on diet with or without dsRNA for 2 days and molted to the third larval stage. At this new larval stage the CPB were observed to reduce significantly or stop altogether their feeding, with an increase in mortality as a result.

D. Bioassay of dsRNA Targets Using Potato Leaf Discs for Activity Against the *Leptinotarsa decemlineata*

An alternative bioassay method was employed using potato leaf material rather than artificial diet as food source for CPB. Discs of approximately 1.1 cm in diameter (or 0.95 cm²) were cut out off leaves of 2 to 3-week old potato plants using a suitably-sized cork borer. Treated leaf discs were prepared by applying 20 μA of a 10 ng/μl solution of target LD002 dsRNA or control gfp dsRNA on the adaxial leaf surface. The leaf discs were allowed to dry and placed individually in 24 wells of a 24-well multiplate (Nunc). A single second-larval stage CPB was placed into each well, which was then covered with tissue paper and a multiwell plastic lid. The plate containing the insects and leaf discs were kept in an insect chamber at 28° C. with a photoperiod of 16 h light/8 h dark. The insects were allowed to feed on the leaf discs for 2 days after which the insects were transferred to a new plate containing fresh treated leaf discs. Thereafter, the insects were transferred to a plate containing untreated leaf discs every day until day 7. Insect mortality and weight scores were recorded.

Figure 3:
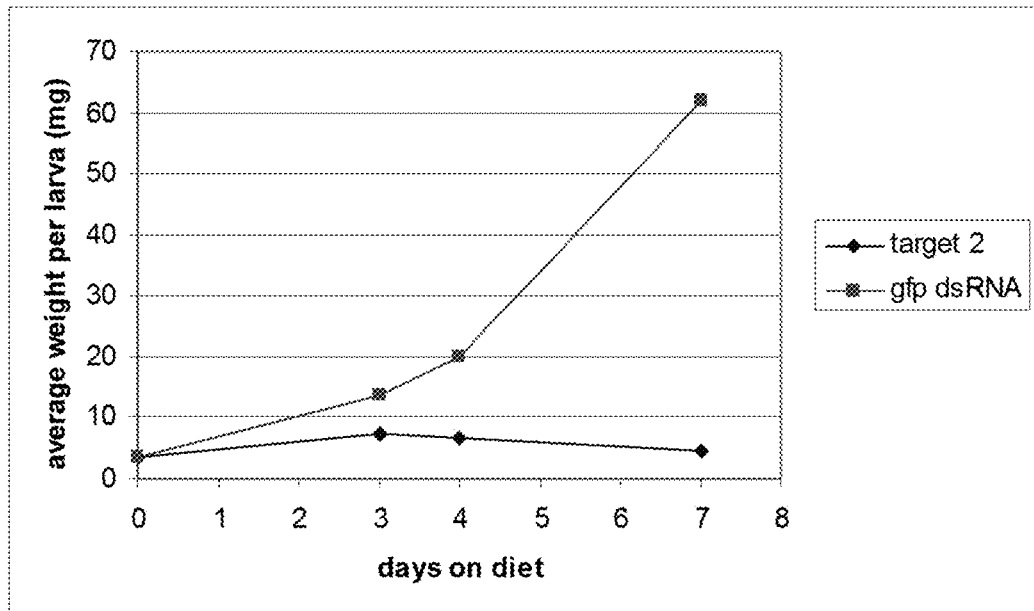
FIG. 3: Average weight of L. decemlineata larvae on potato leaf discs treated with dsRNA. Insects of the second larval stage were fed leaf discs treated with 20 µl of a topically-applied solution (10 ng/µl) of dsRNA (target LD002 or gfp). After two days the insects were transferred on to untreated leaves every day.
Figure 4:
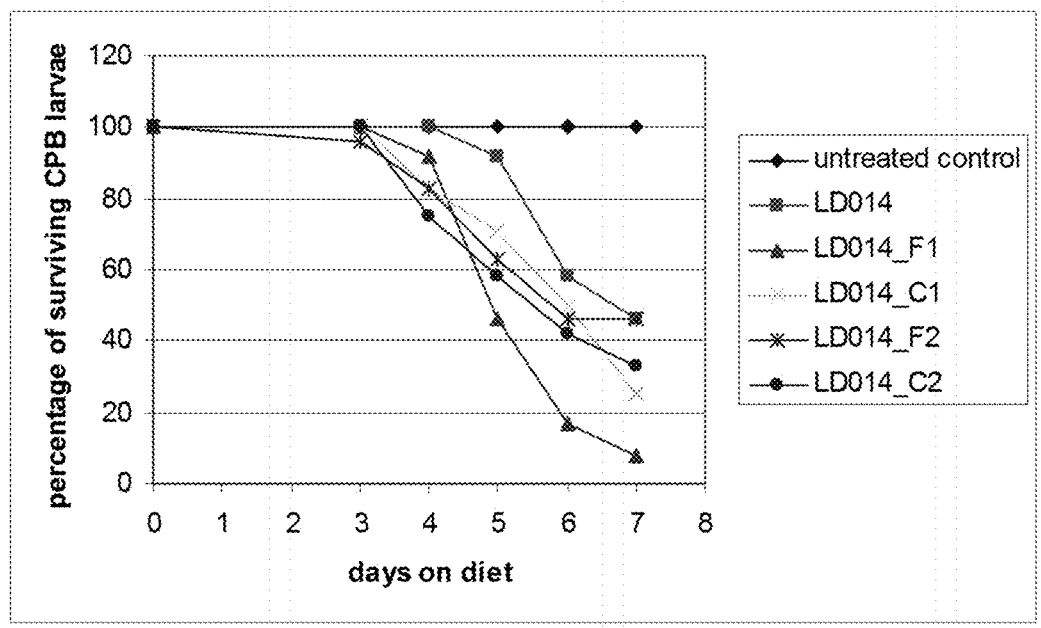
FIG. 4: Survival of L. decemlineata on artificial diet treated with shorter versions of target LD014 dsRNA and concatemer dsRNA. Insects of the second larval stage were fed diet treated with 50 µl of topically-applied solution of dsRNA (gfp or targets). The number of surviving insects were assessed at days 3, 4, 5, 6, & 7. The percentage of surviving larvae were calculated relative to day 0 (start of assay).
Figure 5A:
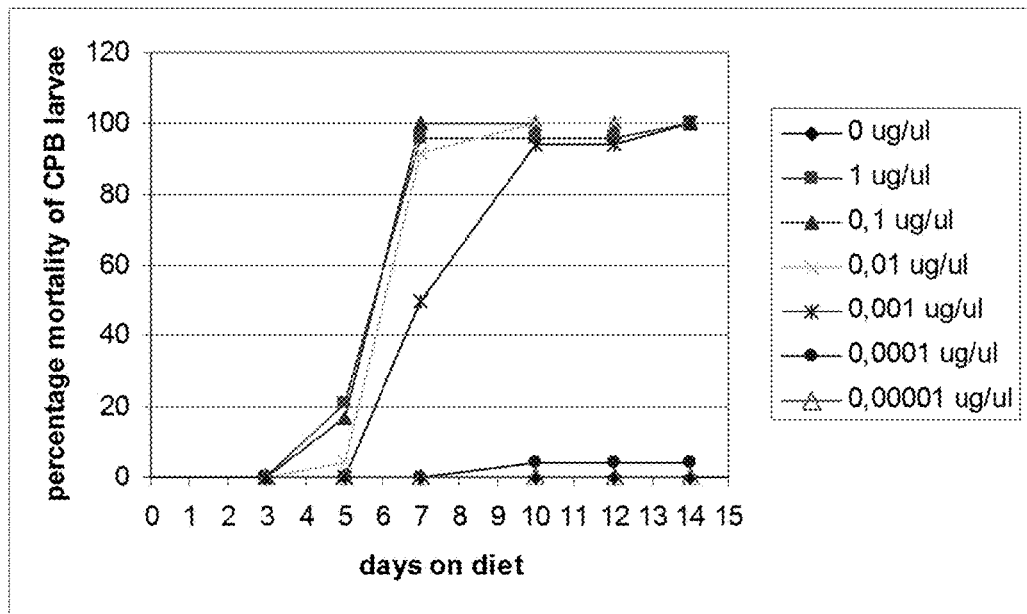
FIG. 5: Survival of L. decemlineata larvae on artificial diet treated with different concentrations of dsRNA of target LD002 (a), target LD007 (b), target LD010 (c), target LD011 (d), target LD014 (e), target LD015 (f), LD016 (g) and target LD027 (h). Insects of the second larval stage were fed diet treated with 50 µl of topically-applied solution of dsRNA. Diet was replaced with fresh diet containing topically-applied dsRNA after 7 days. The number of surviving insects were assessed at regular intervals. The percentage of surviving larvae were calculated relative to day 0 (start of assay).
Figure 5B:
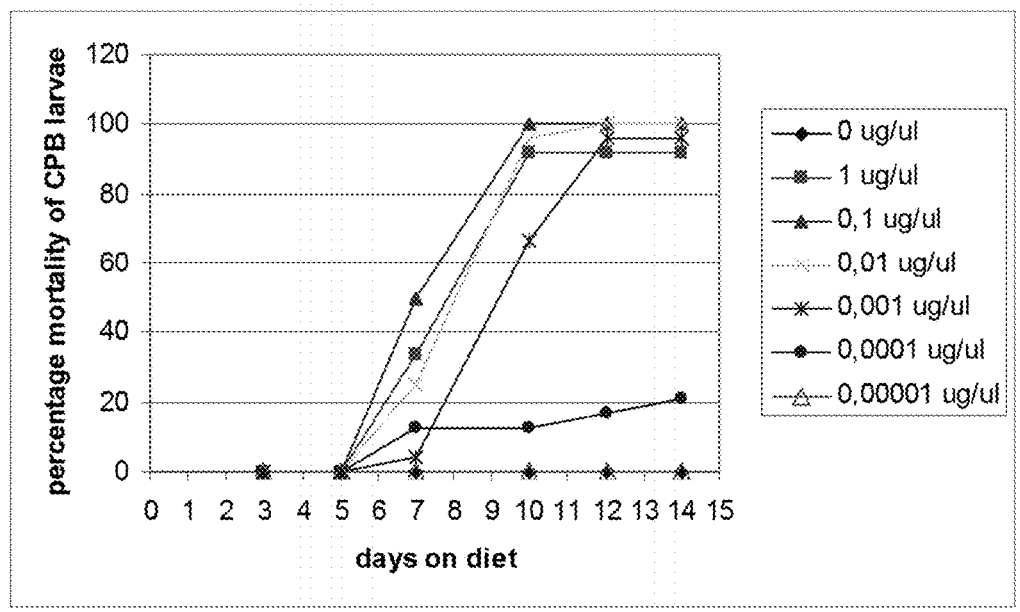
Figure 5C:
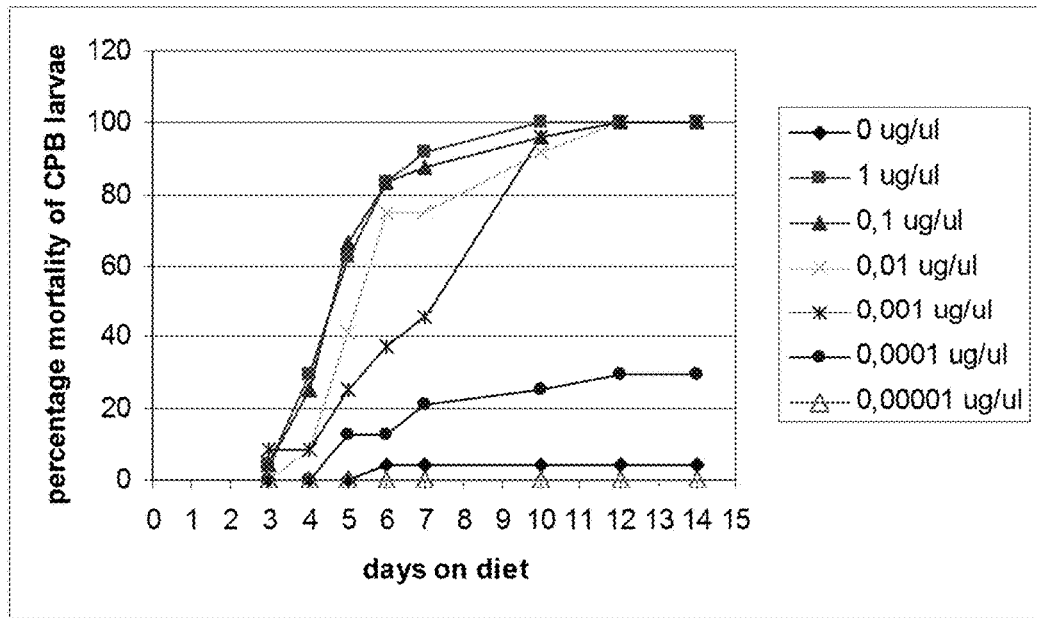
Figure 5D:
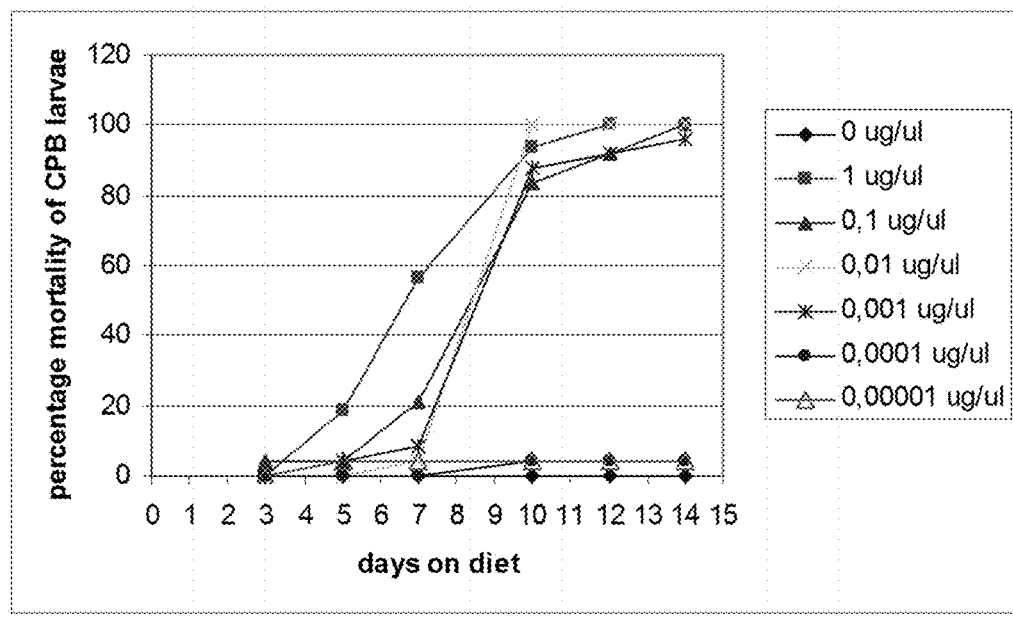
Figure 5E:
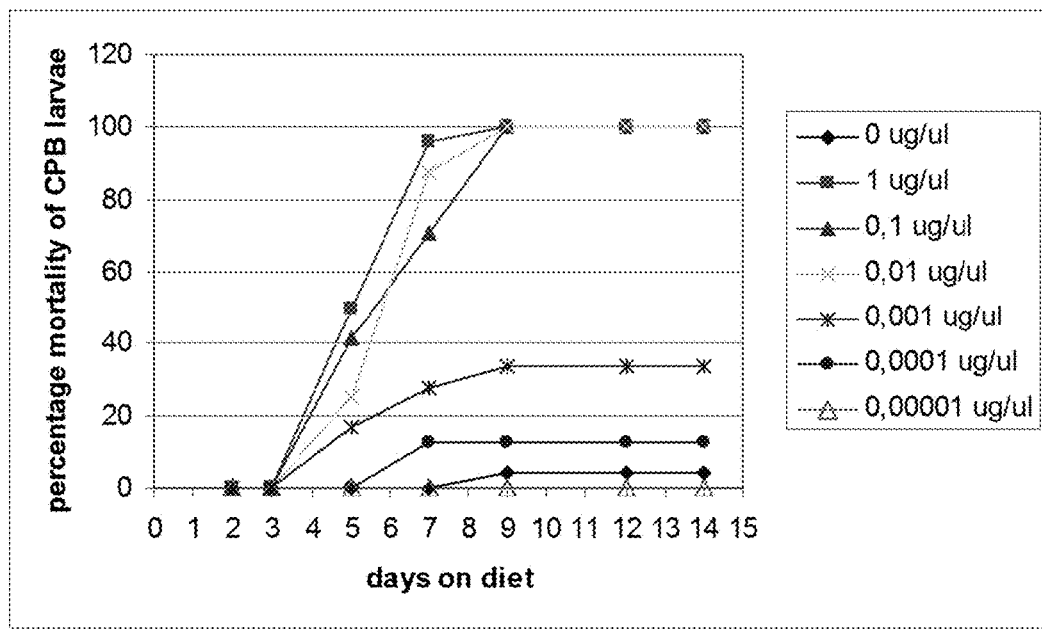
Figure 5F:
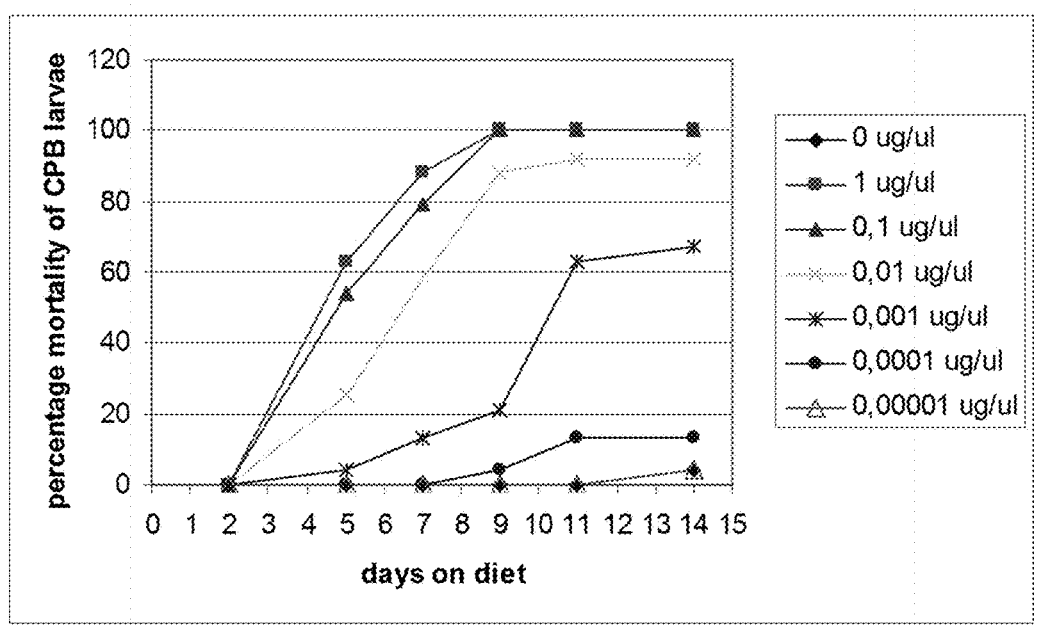
Figure 5G:
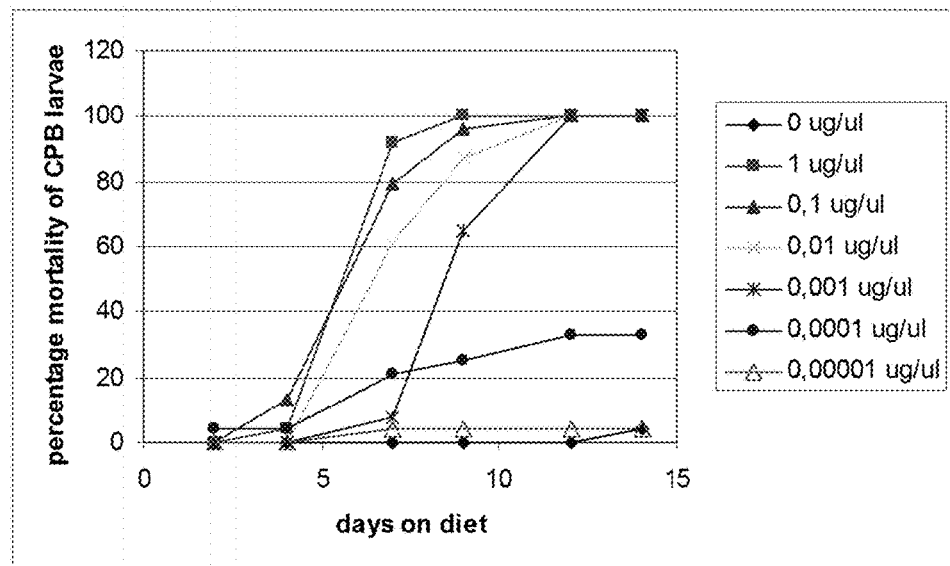
Figure 5H:
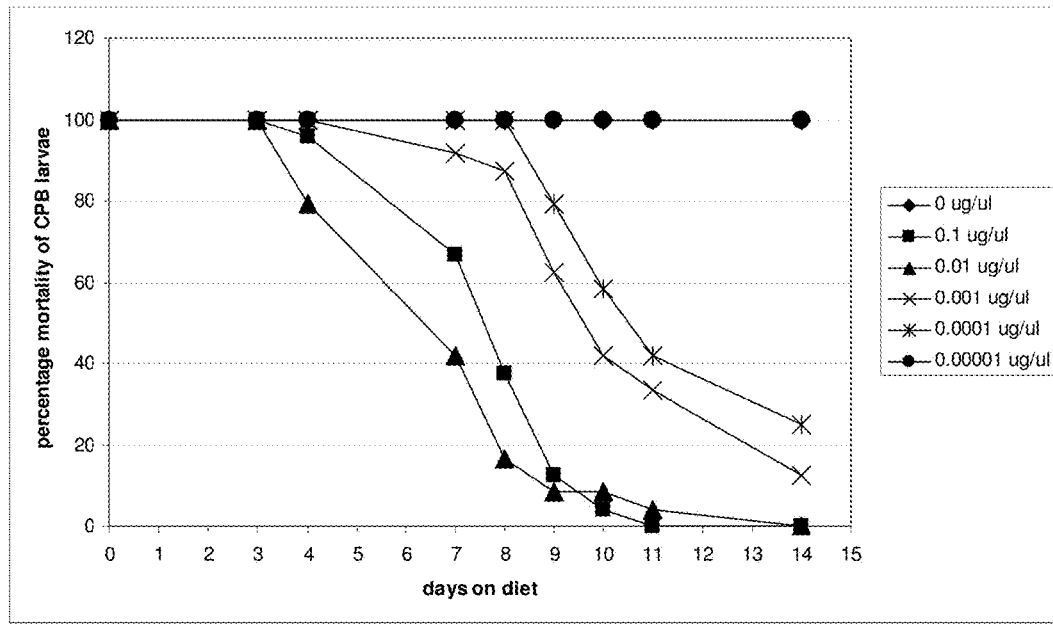
Figure 6A:
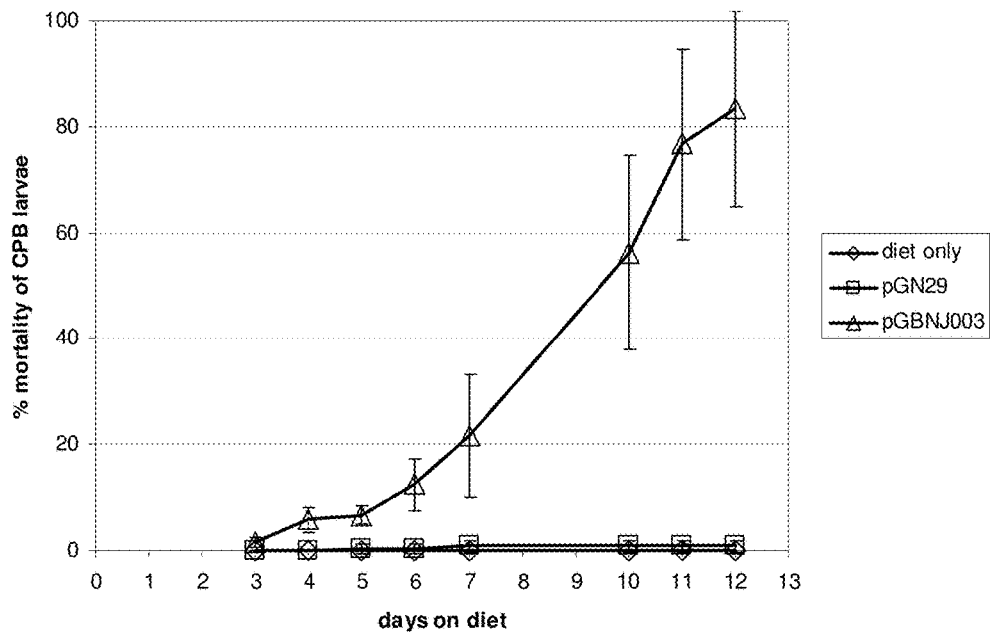
FIG. 6. Effects of *E. coli* strains expressing dsRNA target LD010 on survival of larvae of the Colorado potato beetle, *Leptinotarsa decemlineata*, over time. The two bacterial strains were tested in separate artificial diet-based bioassays: (6A) AB309-105; data points for pGBNJ003 and pGN29 represent average mortality values from 5 different bacterial clones, (6B) BL21(DE3); data points for pGBNJ003 and pGN29 represent average mortality values from 5 different and one single bacterial clones, respectively. Error bars represent standard deviations.
Figure 6B:
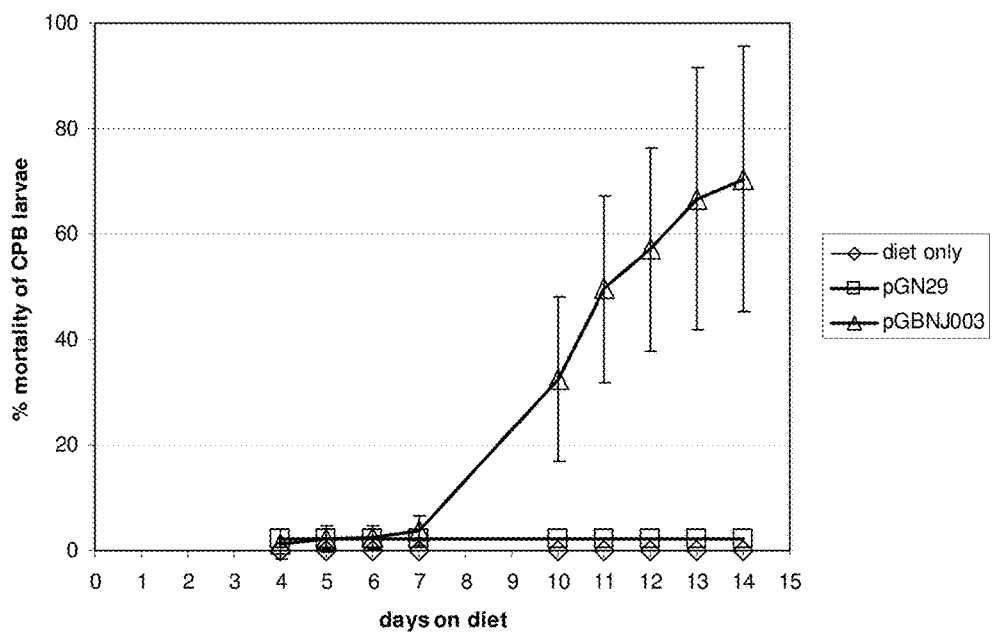
Figure 7A:
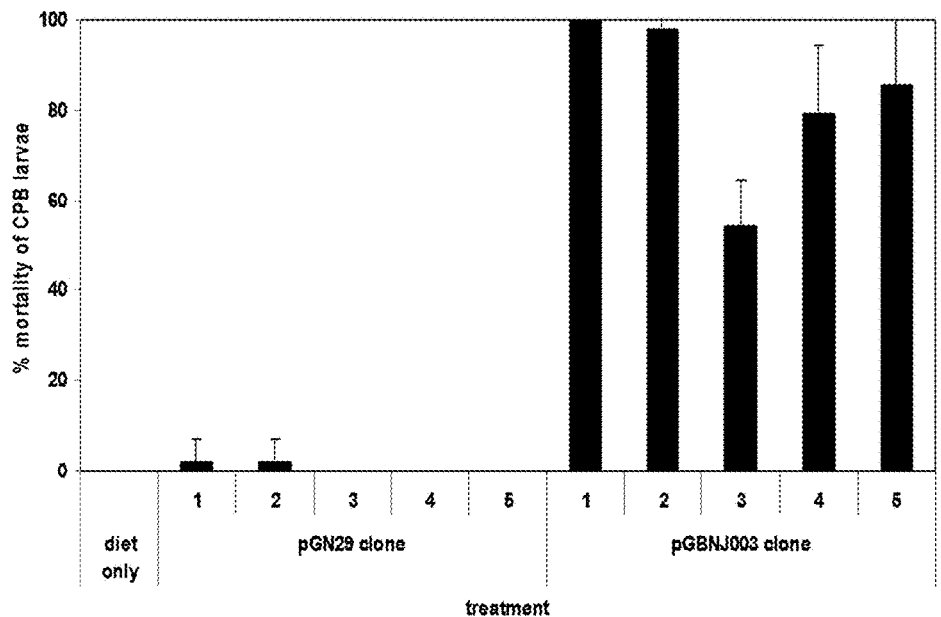
FIG. 7. Effects of different clones of *E. coli* strains (7A) AB309-105 and (7B) BL21(DE3) expressing dsRNA target LD010 on survival of larvae of the Colorado potato beetle, *Leptinotarsa decemlineata*, 12 days post infestation. Data points are average mortality values for each clone for pGN29 and pGBNJ003. Clone 1 of AB309-105 harbouring plasmid pGBNJ003 showed 100% mortality towards CPB at this timepoint. Error bars represent standard deviations.
Figure 7B:
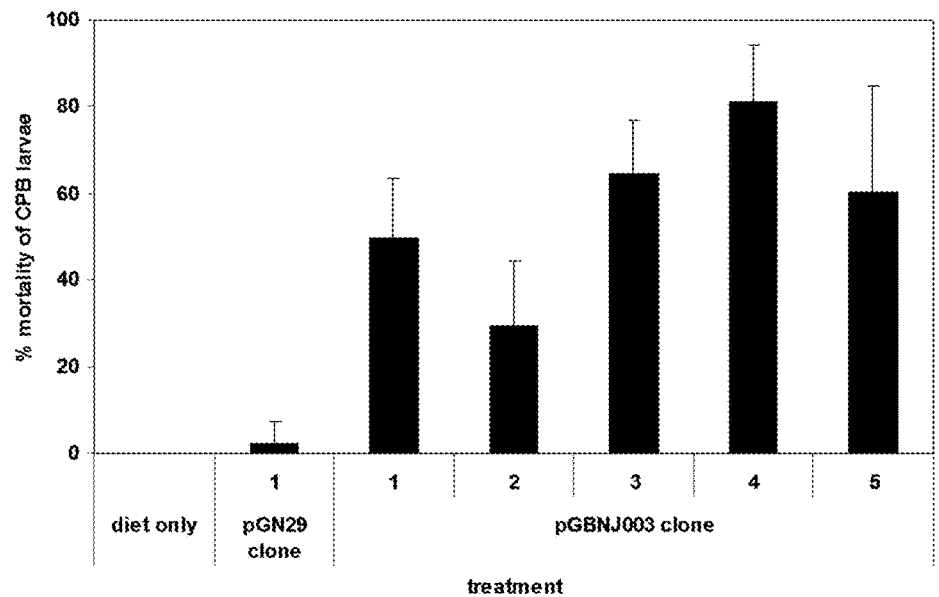
Figure 8A:
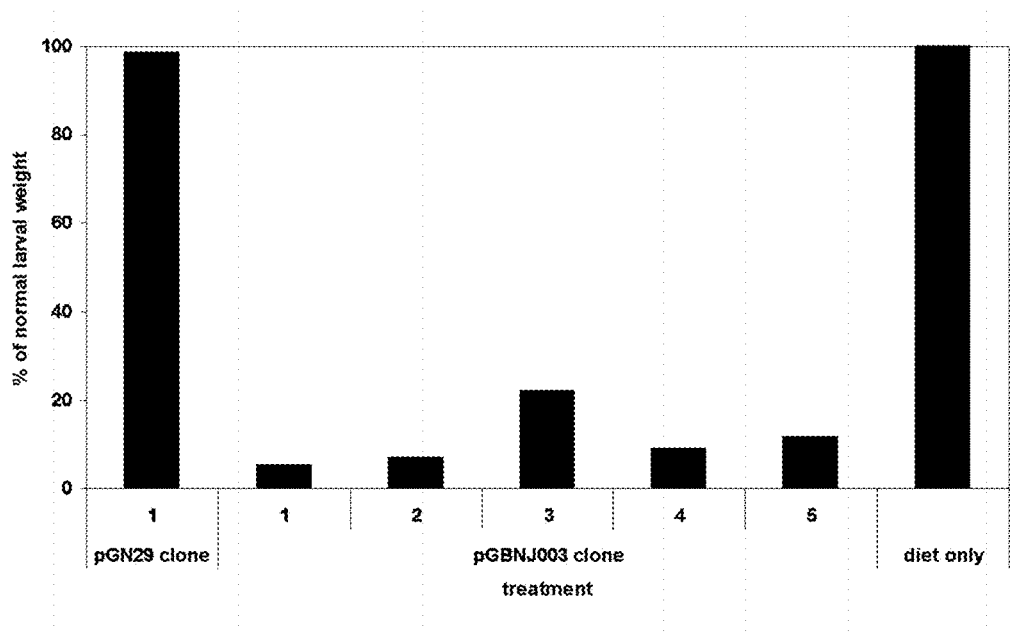
FIG. 8. Effects of different clones of *E. coli* strains (8A) AB309-105 and (8B) BL21(DE3) expressing dsRNA target LD010 on growth and development of larval survivors of the Colorado potato beetle, *Leptinotarsa decemlineata*, 7 days post infestation. Data points are % average larval weight values for each clone (one clone for pGN29 and five clones for pGBNJ003) based on the data of Table 10. Diet only treatment represents 100% normal larval weight.
Figure 8B:
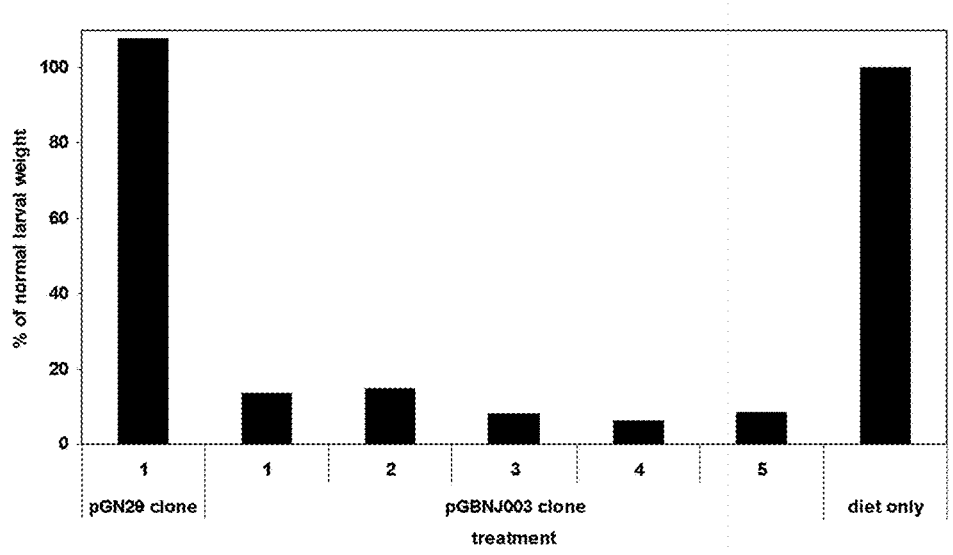
Figure 9:
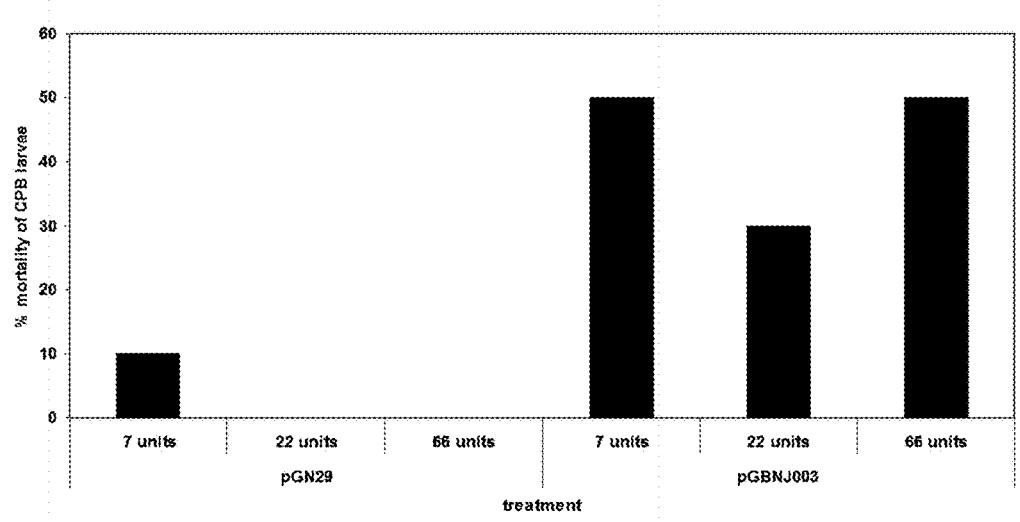
FIG. 9. Survival of larvae of the Colorado potato beetle, *Leptinotarsa decemlineata*, on potato plants sprayed by double-stranded RNA-producing bacteria 7 days post infestation. Number of larval survivors were counted and expressed in terms of % mortality. The bacterial host strain used was the RNaseIII-deficient strain AB309-105. Insect gene target was LD010.
Figure 10:
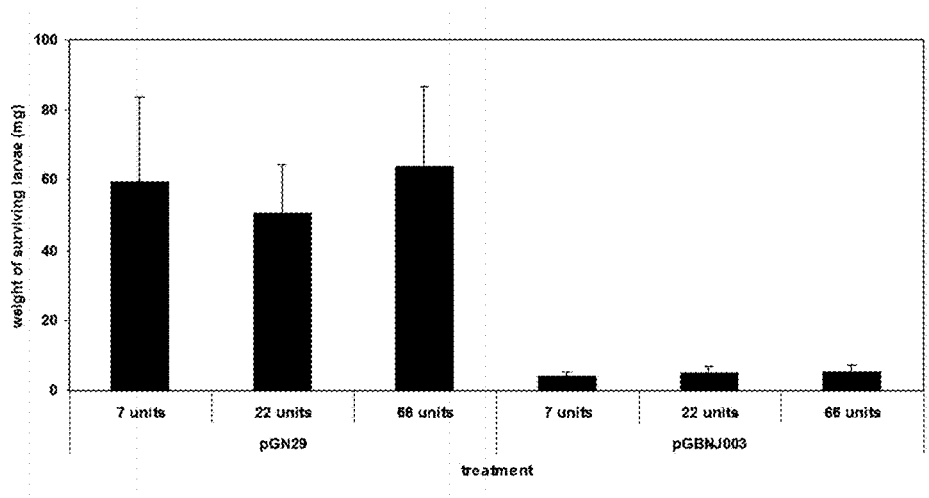
FIG. 10. Growth/developmental delay of larval survivors of the Colorado potato beetle, *Leptinotarsa decemlineata*, fed on potato plants sprayed with dsRNA-producing bacteria 11 days post infestation. The bacterial host strain used was the RNaseIII-deficient strain AB309-105. Data figures represented as percentage of normal larval weight; 100% of normal larval weight given for diet only treatment. Insect gene target was LD010. Error bars represent standard deviations.
Figure 11:
FIG. 11. Resistance to potato damage caused by larvae of the Colorado potato beetle, *Leptinotarsa decemlineata*, by double-stranded RNA-producing bacteria 7 days post infestation. Left, plant sprayed with 7 units of bacteria AB309-105 containing the pGN29 plasmid; right, plant sprayed with 7 units of bacteria Ab309-105 containing the pGBNJ003 plasmid. One unit is defined as the equivalent of 1 ml of a bacterial suspension at OD value of 1 at 600 nm. Insect gene target was LD010.
Figure 12:
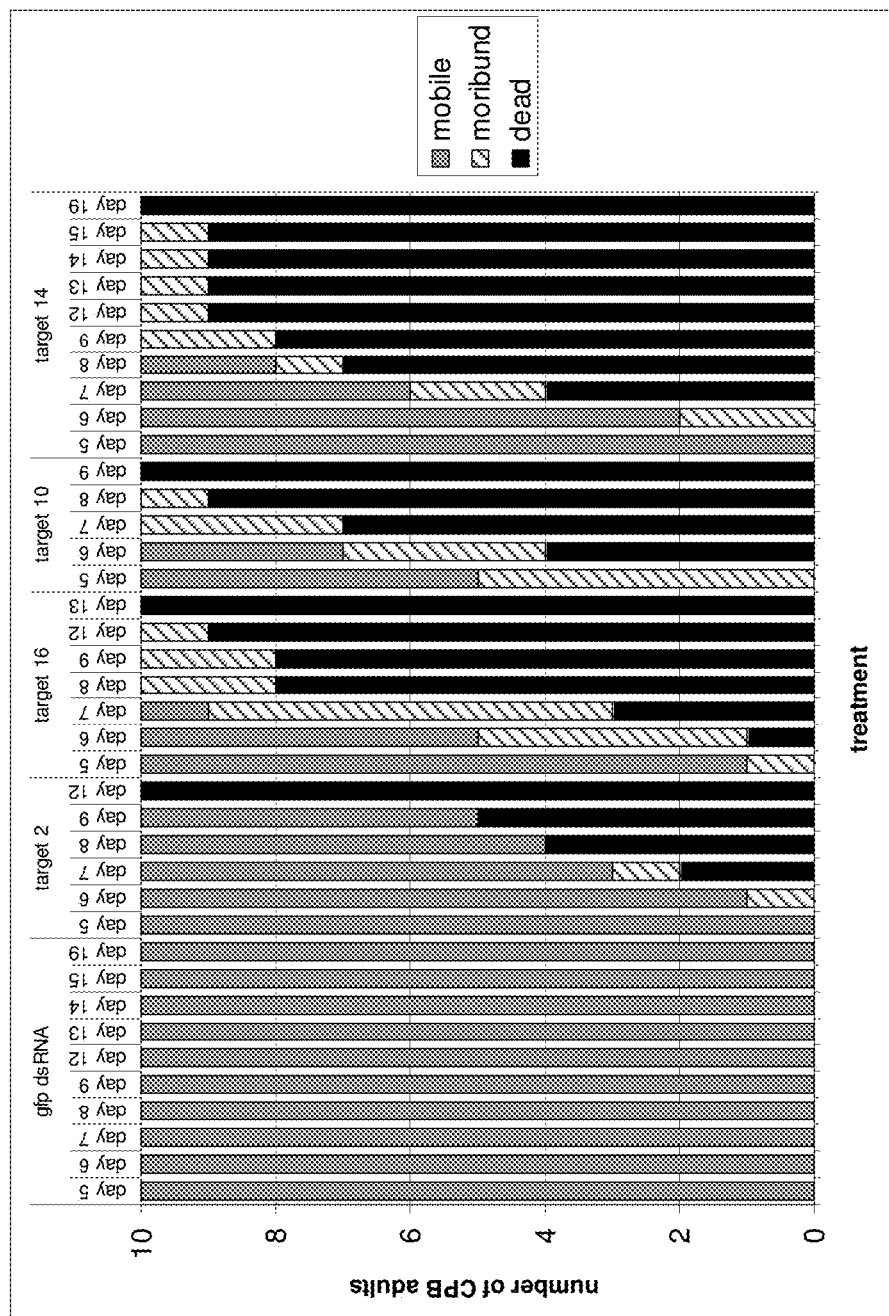
FIG. 12. Survival of *L. decemlineata* adults on potato leaf discs treated with dsRNA. Young adult insects were fed double-stranded-RNA-treated leaf discs for the first two days and were then placed on untreated potato foliage. The number of surviving insects were assessed regularly; mobile insects were recorded as insects which were alive and appeared to move normally; moribund insects were recorded as insects which were alive but appeared sick and slow moving—these insects were not able to right themselves once placed on their backs. Target LD002 (SEQ ID NO: 168); Target LD010 (SEQ ID NO: 188); Target LD014 (SEQ ID NO: 198); Target LD016 (SEQ ID NO: 220); gfp dsRNA (SEQ ID NO: 235).
Figure 13A:
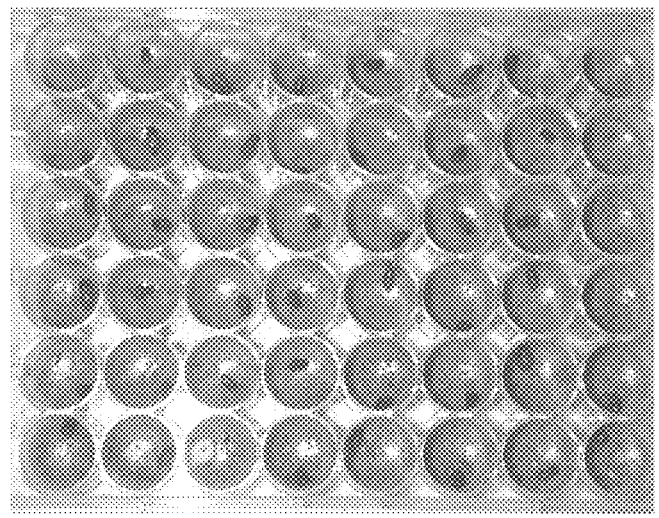
FIG. 13. Effects of bacterial produced target double-stranded RNA against larvae of *L. decemlineata*. Fifty µl of an OD 1 suspension of heat-treated bacteria expressing dsRNA (SEQ ID NO: 188) was applied topically onto the solid artificial diet in each well of a 48-well plate. CPB larvae at L2 stage were placed in each well. At day 7, a picture was taken of the CPB larvae in a plate containing (13A) diet with bacteria expressing target 10 double-stranded RNA, (13B) diet with bacteria harbouring the empty vector pGN29, and, (13C) diet only.
Figure 13B:
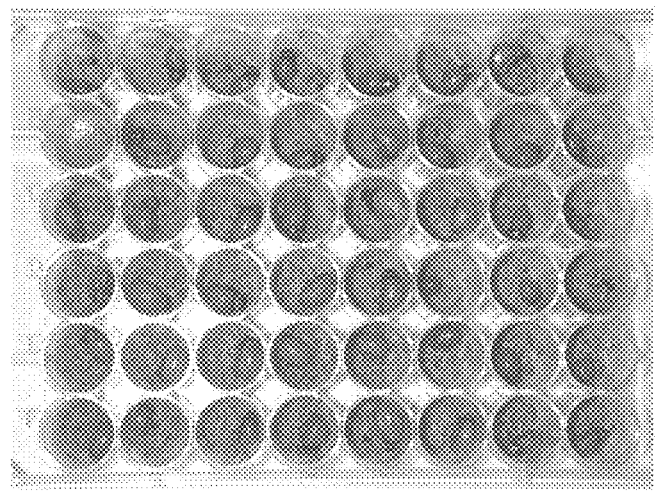
Figure 13C:
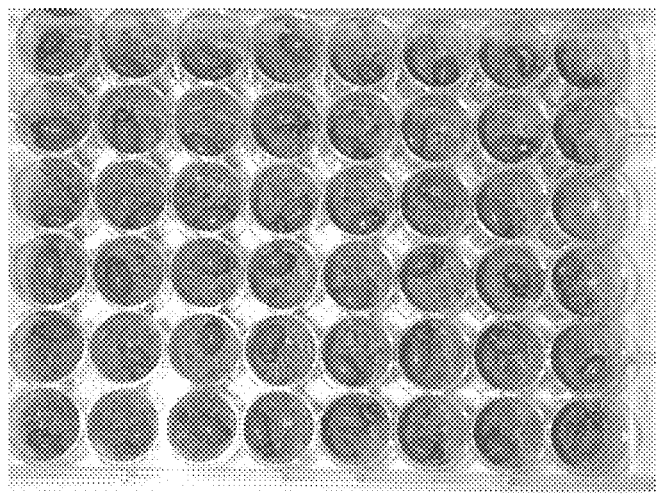
Figure 14:
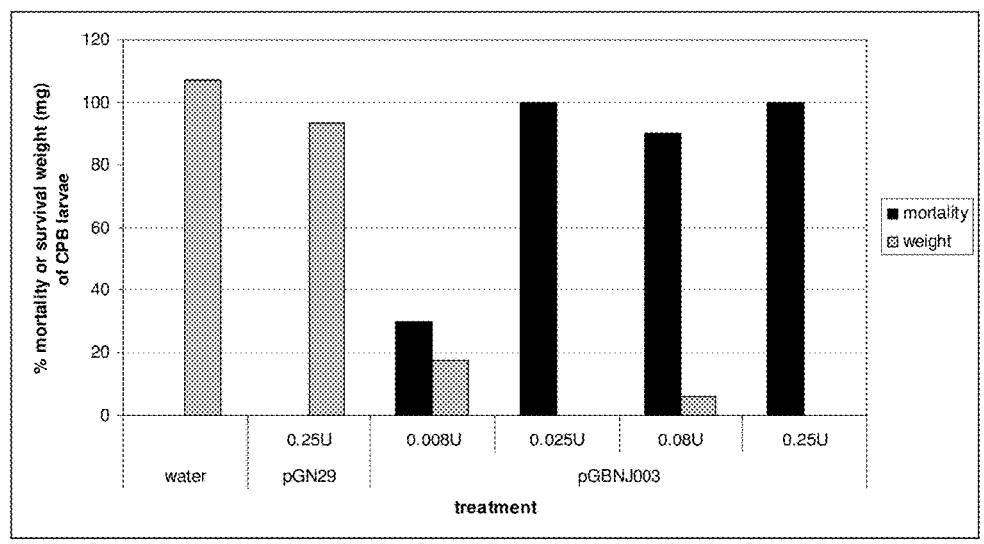
FIG. 14 Effects on CPB larval survival and growth of different amounts of inactivated *E. coli* AB309-105 strain harbouring plasmid pGBNJ003 topically applied to potato foliage prior to insect infestation. Ten L1 larvae were fed treated potato for 7 days. Amount of bacterial suspension sprayed on plants: 0.25 U, 0.08 U, 0.025 U, 0.008 U of target 10 and 0.25 U of pGN29 (negative control; also included is Milli-Q water). One unit (U) is defined as the equivalent bacterial amount present in 1 ml of culture with an optical density value of 1 at 600 nm. A total volume of 1.6 ml was sprayed on to each plant. Insect gene target was LD010.
Figure 15A:
FIG. 15 Resistance to potato damage caused by CPB larvae by inactivated *E. coli* AB309-105 strain harbouring plasmid pGBNJ003 seven days post infestation. (15A) water, (15B) 0.25 U *E. coli* AB309-105 harbouring pGN29, (15C) 0.025 U *E. coli* AB309-105 harbouring pGBNJ003, (15D) 0.008 U *E. coli* AB309-105 harbouring pGBNJ003. One unit (U) is defined as the equivalent bacterial amount present in 1 ml of culture with an optical density value of 1 at 600 nm. A total volume of 1.6 ml was sprayed on to each plant. Insect gene target was LD010.
Figure 15B:
Figure 15C:
Figure 15D:

Feeding potato leaf discs with surface-applied intact naked dsRNA of target LD002 to *L. decemlineata* larvae resulted in a significant increase in larval mortalities (i.e. at day 7 all insects were dead; 100% mortality) whereas control gfp dsRNA had no effect on CPB survival. Target LD002 dsRNA severely affected the growth of the larvae after 2 to 3 days whereas the larvae fed with gfp dsRNA at the same concentration developed as normal (FIG. 3).

D. Screening Shorter Versions of dsRNAs Using Artificial Diet for Activity Against *Leptinotarsa decemlineata*

This example exemplifies the finding that shorter (60 or 100 bp) dsRNA fragments on their own or as concatemer constructs are sufficient in causing toxicity towards the Colorado potato beetle.

LD014, a target known to induce lethality in Colorado potato beetle, was selected for this example. This gene encodes a V-ATPase subunit E (SEQ ID NO: 15).

A 100 base pair fragment, LD014_F1, at position 195-294 on SEQ ID NO: 15 (SEQ ID NO: 159) and a 60 base pair fragment, LD014_F2, at position 235-294 on SEQ ID NO: 15 (SEQ ID NO: 160) were further selected. See also Table 7-LD.

Two concatemers of 300 base pairs, LD014_C1 and LD014_C2, were designed (SEQ ID NO: 161 and SEQ ID NO: 162). LD014_C1 contained 3 repeats of the 100 base pair fragment described above (SEQ ID NO: 159) and LD014_C2 contained 5 repeats of the 60 base pair fragment described above (SEQ ID NO: 160). See also Table 7-LD.

The fragments LD014_F1 and LD014_F2 were synthesized as sense and antisense primers. These primers were annealed to create the double strands DNA molecules prior to cloning. XbaI and XmaI restrictions sites were included at the 5' and 3' ends of the primers, respectively, to facilitate the cloning.

The concatemers were made as 300 base pairs synthetic genes. XbaI and XmaI restrictions sites were included at the 5' and 3' ends of the synthetic DNA fragments, respectively, to facilite the cloning.

The 4 DNA molecules, i.e. the 2 single units (LD014_F1 & LD014_F2) and the 2 concatemers (LD014_C1 & LD014_C2), were digested with XbaI and XmaI and subcloned in pBluescriptII SK+ linearised by XbaI and XmaI digests, resulting in recombinant plasmids p1, p2, p3, & p4, respectively.

Double-stranded RNA production: dsRNA was synthesized using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter. For LD014_F1, the sense T7 template was generated using the specific T7 forward primer oGBM159 and the specific reverse primer oGBM164 (represented herein as SEQ ID NO: 204 and SEQ ID NO: 205, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific forward primer oGBM163 and the specific T7 reverse primer oGBM160 (represented herein as SEQ ID NO: 206 and SEQ ID NO: 207, respectively) in a PCR reaction with the same conditions as described above. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, Dnase and Rnase treated, and purified by sodium acetate, following the manufacturer's instructions. The sense strand of the resulting dsRNA is herein represented by SEQ ID NO: 203.

For LD014_F2, the sense T7 template was generated using the specific T7 forward primer oGBM161 and the specific reverse primer oGBM166 (represented herein as SEQ ID NO: 209 and SEQ ID NO: 210, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific forward primer oGBM165 and the specific T7 reverse primer oGBM162 (represented herein as SEQ ID NO: 211 and SEQ ID NO: 212, respectively) in a PCR reaction with the same conditions as described above. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, Dnase and Rnase treated, and purified by sodium acetate, following the manufacturer's instructions. The sense strand of the resulting dsRNA is herein represented by SEQ ID NO: 208.

Also for the concatemers, separate single 5' T7 RNA polymerase promoter templates were generated in two separate PCR reactions, each reaction containing the target sequence in a different orientation relative to the T7 promoter. The recombinant plasmids p3 and p4 containing LD014_C1 & LD014_C2 were linearised with XbaI or XmaI, the two linear fragments for each construct purified and used as template for the in vitro transcription assay, using the T7 promoters flanking the cloning sites. Double-stranded RNA was prepared by in vitro transcription using the T7 RiboMAX™ Express RNAi System (Promega). The sense strands of the resulting dsRNA for LD014_C1 and LD014_C2 are herein represented by SEQ ID NO: 213 and 2114, respectively.

Shorter sequences of target LD014 and concatemers were able to induce lethality in *Leptinotarsa decemlineata*, as shown in FIG. 4-LD.

G. Screening dsRNAs at Different Concentrations Using Artificial Diet for Activity Against *Leptinotarsa decemlineata*

Fifty µl of a solution of dsRNA at serial ten-fold concentrations from 1 µg/µl (for target LD027 from 0.1 µg/µl) down to 0.01 ng/µl was applied topically onto the solid artificial diet in the wells of a 24-well plate (Nunc). The diet was dried in a laminair flow cabin. Per treatment, twenty-four Colorado potato beetle larvae ($2^{nd}$ stage), with two insects per well, were tested. The plates were stored in the insect rearing chamber at 25±2° C., 60% relative humidity, with a 16:8 hours light:dark photoperiod. The beetles were assessed as live or dead at regular intervals up to day 14. After seven days, the diet was replaced with fresh diet with topically applied dsRNA at the same concentrations. The dsRNA targets were compared to diet only.

Feeding artificial diet containing intact naked dsRNAs of different targets to *L. decemlineata* larvae resulted in high larval mortalities at concentrations as low as between 0.1 and 10 ng dsRNA/µl as shown in FIG. 5.

H. Cloning of a CPB Gene Fragment in a Vector Suitable for Bacterial Production of Insect-Active Double-Stranded RNA While any efficient bacterial promoter may be used, a DNA fragment corresponding to an MLB gene target was cloned in a vector for the expression of double-stranded RNA in a bacterial host (See WO 00/01846).

The sequences of the specific primers used for the amplification of target genes are provided in Table 8. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8. The recombinant vector harboring this sequence is named pGBNJ003.

The sequences of the specific primers used for the amplification of target gene fragment LD010 are provided in Table 8 (forward primer SEQ ID NO: 191 and reverse primer SEQ ID NO: 190). The template used was the pCR8/GW/topo vector containing the LD010 sequence (SEQ ID NO: 11). The primers were used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment was analyzed on agarose gel, purified (QIAquick Gel Extraction kit, Cat. Nr. 28706, Qiagen), blunt-end cloned into Srf I-linearized pGNA49A vector (reference to WO 00/188121A1), and sequenced. The sequence of the resulting PCR product corresponds to SEQ ID NO: 188 as given in Table 8. The recombinant vector harboring this sequence was named pGBNJ003.

I. Expression and Production of a Double-Stranded RNA Target in Two Strains of *Escherichia coli*: (1) AB309-105, and, (2) BL21(DE3)

The procedures described below were followed in order to express suitable levels of insect-active double-stranded RNA of target LD010 in bacteria. An RNaseIII-deficient strain, AB309-105, was used in comparison to wild-type RNaseIII-containing bacteria, BL21(DE3).

Transformation of AB309-105 and BL21(DE3)

Three hundred ng of the plasmid was added to and gently mixed in a 50 µl aliquot of ice-chilled chemically competent *E. coli* strain AB309-105 or BL21(DE3). The cells were incubated on ice for 20 minutes before subjecting them to a heat shock treatment of 37° C. for 5 minutes, after which the cells were placed back on ice for a further 5 minutes. Four hundred and fifty µl of room temperature SOC medium was added to the cells and the suspension incubated on a shaker (250 rpm) at 37° C. for 1 hour. One hundred µl of the bacterial cell suspension was transferred to a 500 ml conical flask containing 150 ml of liquid Luria-Bertani (LB) broth supplemented with 100 µg/ml carbenicillin antibiotic. The culture was incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) was made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture was measured using an appropriate spectrophotometer and adjusted to a value of 1 by the addition of fresh LB broth. Fifty ml of this culture was transferred to a 50 ml Falcon tube and the culture then centrifuged at 3000 g at 15° C. for 10 minutes. The supernatant was removed and the bacterial pellet resuspended in 50 ml of fresh S complete medium (SNC medium plus 5 µg/ml cholesterol) supplemented with 100 µg/ml carbenicillin and 1 mM IPTG. The bacteria were induced for 2 to 4 hours at room temperature.

Heat Treatment of Bacteria

Bacteria were killed by heat treatment in order to minimize the risk of contamination of the artificial diet in the test plates. However, heat treatment of bacteria expressing double-stranded RNA is not a prerequisite for inducing toxicity towards the insects due to RNA interference. The induced bacterial culture was centrifuged at 3000 g at room temperature for 10 minutes, the supernatant discarded and the pellet subjected to 80° C. for 20 minutes in a water bath. After heat treatment, the bacterial pellet was resuspended in 1.5 ml MilliQ water and the suspension transferred to a microfuge tube. Several tubes were prepared and used in the bioassays for each refreshment. The tubes were stored at −20° C. until further use.

J. Laboratory Trials to Test *Escherichia coli* Expressing dsRNA Target LD010 Against *Leptinotarsa decemlineata*

Two bioassay methods were employed to test double-stranded RNA produced in *Escherichia coli* against larvae of the Colorado potato beetle: (1) artificial diet-based bioassay, and, (2) plant-based bioassay.

Artificial Diet-Based Bioassays

Artificial diet for the Colorado potato beetle was prepared as described previously in Example 4. A half milliliter of diet was dispensed into each of the wells of a 48-well multiwell test plate (Nunc). For every treatment, fifty μl of an OD 1 suspension of heat-treated bacteria (which is equivalent to approximately $5\times10^7$ bacterial cells) expressing dsRNA was applied topically onto the solid diet in the wells and the plates were allowed to dry in a laminair flow cabin. Per treatment, forty-eight $2^{nd}$ stage Colorado potato beetle larvae, one in each well containing diet and bacteria, were tested. Each row of a plate (i.e. 8 wells) was considered as one replicate. The plates were kept in the insect rearing chamber at 25±2° C., 60±5% relative humidity, with a 16:8 hours light:dark photoperiod. After every 4 days, the beetles were transferred to fresh diet containing topically-applied bacteria. The beetles were assessed as alive or dead every one or three days post infestation. For the survivors, growth and development in terms of larval weight was recorded on day 7 post infestation.

For RNaseIII-deficient *E. coli* strain AB309-105, bacteria containing plasmid pGBNJ003 and those containing the empty vector pGN29 (reference to WO 00/188121A1) were tested in bioassays for CPB toxicity. Bacteria harboring the pGBNJ003 plasmid showed a clear increase in insect mortality with time, whereas little or no mortality was observed for pGN29 and diet only control (FIGS. 6A & 7A). The growth and development of Colorado potato beetle larval survivors, 7 days after feeding on artificial diet containing bacteria expressing dsRNA target LD010, was severely impeded (Table 10-LD, FIG. 8A).

For *E. coli* strain BL21(DE3), bacteria containing plasmid pGBNJ003 and those containing the empty vector pGN29 were tested against the Colorado potato beetle larvae. Similar detrimental effects were observed on larvae fed diet supplemented with BL21(DE3) bacteria as for the RNAseIII-deficient strain, AB309-105 (FIGS. 6B & 7B). However, the number of survivors for the five clones were higher for BL21(DE3) than for AB309-105; at day 12, average mortality values were approximately 25% lower for this strain compared to the RNase III deficient strain. Also, the average weights of survivors fed on diet containing BL21 (DE3) expressing dsRNA corresponding to target LD010 was severely reduced (Table 10-LD, FIG. 8B).

The delay in growth and development of the CPB larvae fed on diet containing either of the two bacterial strains harboring plasmid pGBNJ003 was directly correlated to feeding inhibition since no frass was visible in the wells of refreshed plates from day 4 onwards when compared to bacteria harboring the empty vector pGN29 or the diet only plate. This observation was similar to that where CPB was fed on in vitro transcribed double-stranded RNA topically applied to artificial diet (see Example 3D); here, cessation of feeding occurred from day 2 onwards on treated diet.

Plant-Based Bioassays

Whole potato plants were sprayed with suspensions of chemically induced bacteria expressing dsRNA prior to feeding the plants to CPB larvae. The potato plants of variety 'line 5' were grown from tubers to the 8-12 unfolded leaf stage in a plant growth room chamber with the following conditions: 25±2° C., 60% relative humidity, 16:8 hour light:dark photoperiod. The plants were caged by placing a 500 ml plastic bottle upside down over the plant with the neck of the bottle firmly placed in the soil in a pot and the base cut open and covered with a fine nylon mesh to permit aeration, reduce condensation inside and prevent larval escape. Fifteen Colorado potato beetle larvae at the L1 stage were placed on each treated plant in the cage. Plants were treated with a suspension of *E. coli* AB309-105 harboring the pGBNJ003 plasmids (clone 1; FIG. 7A) or pGN29 plasmid (clone 1; see FIG. 7A). Different quantities of bacteria were applied to the plants: 66, 22, and 7 units, where one unit is defined as $10^9$ bacterial cells in 1 ml of a bacterial suspension at optical density value of 1 at 600 nm wavelength. In each case, a total volume of 1.6 ml was sprayed on the plant with the aid of a vaporizer. One plant was used per treatment in this trial. The number of survivors were counted and the weight of each survivor recorded.

Spraying plants with a suspension of *E. coli* bacterial strain AB309-105 expressing target dsRNA from pGBNJ003 led to a dramatic increase in insect mortality when compared to pGN29 control. The mortality count was maintained when the amount of bacteria cell suspension was diluted 9-fold (FIG. 9). The average weights of the larval survivors at day 11 on plants sprayed with bacteria harboring the pGBNJ003 vector were approximately 10-fold less than that of pGN29 (FIG. 10). Feeding damage by CPB larvae of the potato plant sprayed with bacteria containing the pGBNJ003 plasmid was much reduced when compared to the damage incurred on a potato plant sprayed with bacteria containing the empty vector pGN29 (FIG. 11).

These experiments showed that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification was provided for the effective protection of plants/crops from insect damage by the use of a spray of a formulation consisting of bacteria expressing double-stranded RNA corresponding to an insect gene target.

K. Testing Various Culture Suspension Densities of *Escherichia coli* Expressing dsRNA Target LD010 Against *Leptinotarsa decemlineata*

Preparation and treatment of bacterial cultures are described in Example 3J. Three-fold serial dilutions of cultures (starting from 0.25 unit equivalents) of *Escherichia coli* RNAseIII-deficient strain AB309-105 expressing double-stranded RNA of target LD010 were applied to foliages of the potato plant of variety 'Bintje' at the 8-12 unfolded leaf stage. Ten L1 larvae of the *L. decemlineata* were placed on the treated plants with one plant per treatment. Scoring for insect mortality and growth impediment was done on day 7 (i.e., 7 days post infestation).

As shown in FIG. 14, high CPB larval mortality (90 to 100%) was recorded after 1 week when insects were fed potato plants treated with a topical application by fine spray of heat-inactivated cultures of *E. coli* harboring plasmid pGBNJ003 (for target 10 dsRNA expression) at densities 0.25, 0.08 and 0.025 bacterial units. At 0.008 units, about a third of the insects were dead, however, the surviving insects were significantly smaller than those in the control groups (*E. coli* harbouring the empty vector pGN29 and water only). Feeding damage by CPB larvae of the potato plant sprayed with bacteria containing the pGBNJ003 plasmid at concentrations 0.025 or 0.008 units was much reduced when compared to the damage incurred on a potato plant sprayed with bacteria containing the empty vector pGN29 (FIG. 15).

L. Adults are Extremely Susceptible to Orally Ingested dsRNA Corresponding to Target Genes The example provided below highlights the finding that adult insects (and not only insects of the larval stage) are extremely susceptible to orally ingested dsRNA corresponding to target genes.

Four targets were chosen for this experiment: targets 2, 10, 14 and 16 (SEQ ID NO: 168, 188, 198 and 220, respectively). GFP fragment dsRNA (SEQ ID NO: 235) was used as a control. Young adults (2 to 3 days old) were picked at random from our laboratory-reared culture with no bias towards insect gender. Ten adults were chosen per treatment. The adults were prestarved for at least 6 hours before the onset of the treatment. On the first day of treatment, each adult was fed four potato leaf discs (diameter 1.5 $cm^2$) which were pretreated with a topical application of 25 μl of 0.1 μg/μl target dsRNA (synthesized as described in Example 3A; topical application as described in Example 3E) per disc. Each adult was confined to a small petridish (diameter 3 cm) in order to make sure that all insects have ingested equal amounts of food and thus received equal doses of dsRNA. The following day, each adult was again fed four treated leaf discs as described above. On the third day, all ten adults per treatment were collected and placed together in a cage consisting of a plastic box (dimensions 30 cm×20 cm×15 cm) with a fine nylon mesh built into the lid to provide good aeration. Inside the box, some moistened filter paper was placed in the base. Some (untreated) potato foliage was placed on top of the paper to maintain the adults during the experiment. From day 5, regular assessments were carried out to count the number of dead, alive (mobile) and moribund insects. For insect moribundity, adults were laid on their backs to check whether they could right themselves within several minutes; an insect was considered moribund only if it was not able to turn onto its front.

Clear specific toxic effects of double-stranded RNA corresponding to different targets towards adults of the Colorado potato beetle, *Leptinotarsa decemlineata*, were demonstrated in this experiment (FIG. 12). Double-stranded RNA corresponding to a gfp fragment showed no toxicity towards CPB adults on the day of the final assessment (day 19). This experiment clearly showed that the survival of CPB adults was severely reduced only after a few days of exposure to dsRNA when delivered orally. For example, for target 10, on day 5, 5 out of 10 adults were moribund (sick and slow moving); on day 6, 4 out of 10 adults were dead with three of the survivors moribund; on day 9 all adults were observed dead.

As a consequence of this experiment, the application of target double-stranded RNAs against insect pests may be broadened to include the two life stages of an insect pest (i.e. larvae and adults) which could cause extensive crop damage, as is the case with the Colorado potato beetle.

Example 4: *Phaedon cochleariae* (Mustard Leaf Beetle)

A. Cloning of a Partial Sequence of the *Phaedon cochleariae* (Mustard Leaf Beetle) PC001, PC003, PC005, PC010, PC014, PC016 and PC027 Genes Via Family PCR High quality, intact RNA was isolated from the third larval stage of *Phaedon cochleariae* (mustard leaf beetle; source: Dr. Caroline Muller, Julius-von-Sachs-Institute for Biosciences, Chemical Ecology Group, University of Wuerzburg, Julius-von-Sachs-Platz 3, D-97082 Wuerzburg, Germany) using TRIzol Reagent (Cat. Nr. 15596-026/15596-018, Invitrogen, Rockville, Md., USA) following the manufacturer's instructions. Genomic DNA present in the RNA preparation was removed by DNase (Cat. Nr. 1700, Promega) treatment following the manufacturer's instructions. cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the PC001, PC003, PC005, PC010, PC014, PC016 and PC027 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-PC. Table 2-PC displays *Phaedon cochleariae* target genes including primer sequences and cDNA sequences obtained. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K4530-20, Invitrogen) and sequenced. The sequences of the resulting PCR products are represented by the respective SEQ ID NO:s as given in Table 2-PC and are referred to as the partial sequences.

The corresponding partial amino acid sequence are represented by the respective SEQ ID NO:s as given in Table 3-PC. Table 3-PC provides amino acid sequences of cDNA clones, and the start of the reading frame is indicated in brackets.

B. dsRNA Production of the *Phaedon cochleariae* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-PC. Table 8-PC provides details for preparing ds RNA fragments of *Phaedon cochleariae* target sequences, including primer sequences.

The conditions in the PCR reactions were as follows: 1 minute at 95° C., followed by 20 cycles of 30 seconds at 95° C., 30 seconds at 60° C. and 1 minute at 72° C., followed by 15 cycles of 30 seconds at 95° C., 30 seconds at 50° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-PC. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-PC.

C. Laboratory Trials to Test dsRNA Targets, Using Oilseed Rape Leaf Discs for Activity Against *Phaedon cochleariae* Larvae The example provided below is an exemplification of the finding that the mustard leaf beetle (MLB) larvae are susceptible to orally ingested dsRNA corresponding to own target genes.

To test the different double-stranded RNA samples against MLB larvae, a leaf disc assay was employed using oilseed rape (*Brassica napus* variety SW Oban; source: Nick Balaam, Sw Seed Ltd., 49 North Road, Abington, Cambridge, CB1 6AS, UK) leaf material as food source. The insect cultures were maintained on the same variety of oilseed rape in the insect chamber at 25±2° C. and 60±5% relative humidity with a photoperiod of 16 h light/8 h dark. Discs of approximately 1.1 cm in diameter (or 0.95 cm$^2$) were cut out off leaves of 4- to 6-week old rape plants using a suitably-sized cork borer. Double-stranded RNA samples were diluted to 0.1 μg/μl in Milli-Q water containing 0.05% Triton X-100. Treated leaf discs were prepared by applying 25 μl of the diluted solution of target PC001, PC003, PC005, PC010, PC014, PC016, PC027 dsRNA and control gfp dsRNA or 0.05% Triton X-100 on the adaxial leaf surface. The leaf discs were left to dry and placed individually in each of the 24 wells of a 24-well multiplate containing 1 ml of gellified 2% agar which helps to prevent the leaf disc from drying out. Two neonate MLB larvae were placed into each well of the plate, which was then covered with a multiwell plastic lid. The plate (one treatment containing 48 insects) was divided into 4 replicates of 12 insects per replicate (each row). The plate containing the insects and leaf discs were kept in an insect chamber at 25±2° C. and 60±5% relative humidity with a photoperiod of 16 h light/8 h dark. The insects were fed leaf discs for 2 days after which they were transferred to a new plate containing freshly treated leaf discs. Thereafter, 4 days after the start of the bioassay, the insects from each replicate were collected and transferred to a Petri dish containing untreated fresh oilseed rape leaves. Larval mortality and average weight were recorded at days 2, 4 7, 9 and 11.

*P. cochleariae* larvae fed on intact naked target dsRNA-treated oilseed rape leaves resulted in significant increases in larval mortalities for all targets tested, as indicated in FIG. 1(*a*). Tested double-stranded RNA for target PC010 led to 100% larval mortality at day 9 and for target PC027 at day 11. For all other targets, significantly high mortality values were reached at day 11 when compared to control gfp dsRNA, 0.05% Trition X-100 alone or untreated leaf only: (average value in percentage±confidence interval with alpha 0.05) PC001 (94.4±8.2); PC003 (86.1±4.1); PC005 (83.3±7.8); PC014 (63.9±20.6); PC016 (75.0±16.8); gfp dsRNA (11.1±8.2); 0.05% Triton X-100 (19.4±10.5); leaf only (8.3±10.5).

Figure 16A:
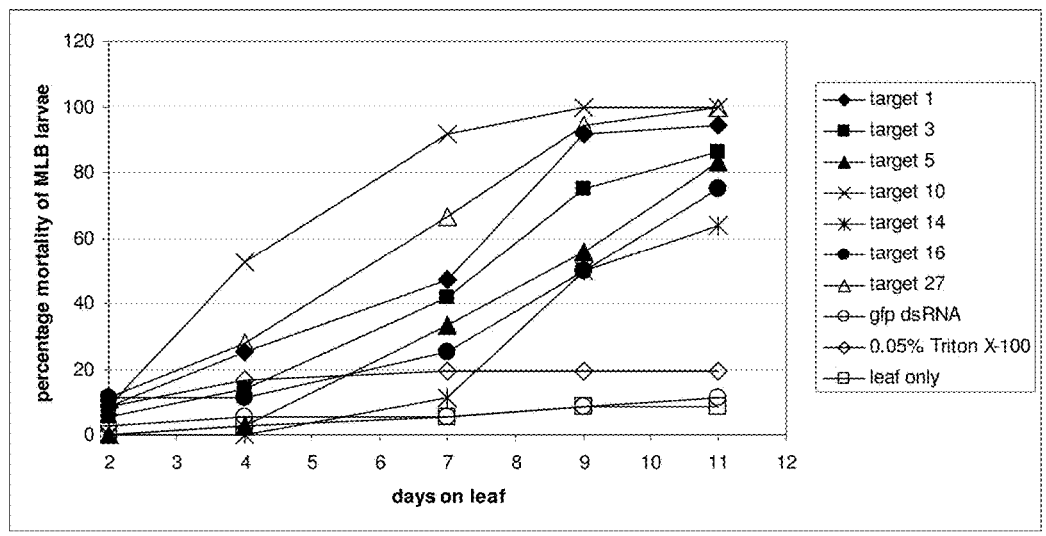
FIG. 16: Effects of ingested target dsRNAs on survival and growth of *P. cochleariae* larvae. Neonate larvae were fed oilseed rape leaf discs treated with 25 µl of topically-applied solution of 0.1 µg/µl dsRNA (targets or gfp control). After 2 days, the insects were transferred onto fresh dsRNA-treated leaf discs. At day 4, larvae from one replicate for every treatment were collected and placed in a Petri dish containing fresh untreated oilseed rape foliage. The insects were assessed at days 2, 4, 7, 9 & 11. (16A) Survival of *E. varivestis* larvae on oilseed rape leaf discs treated with dsRNA. The percentage of surviving larvae was calculated relative to day 0 (start of assay). (16B) Average weights of *P. cochleariae* larvae on oilseed rape leaf discs treated with dsRNA. Insects from each replicate were weighed together and the average weight per larva determined. Error bars represent standard deviations. Target 1: SEQ ID NO: 473; target 3: SEQ ID NO: 478; target 5: SEQ ID NO: 483-; target 10: SEQ ID NO: 488; target 14: SEQ ID NO: 493; target 16: SEQ ID NO: 498; target 27: SEQ ID NO: 503; gfp dsRNA: SEQ ID NO: 235.
Figure 16B:
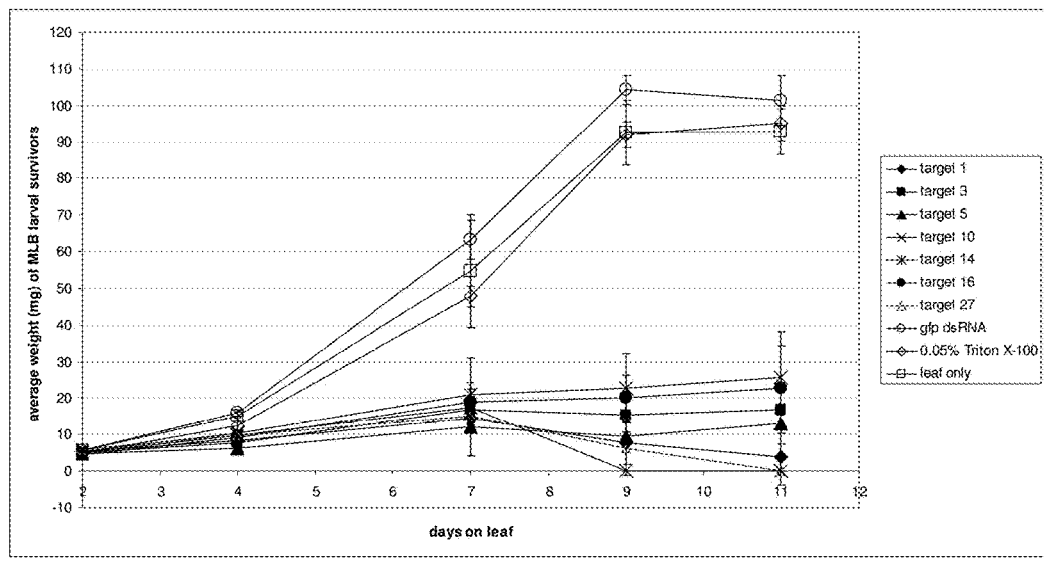
Figure 17A:
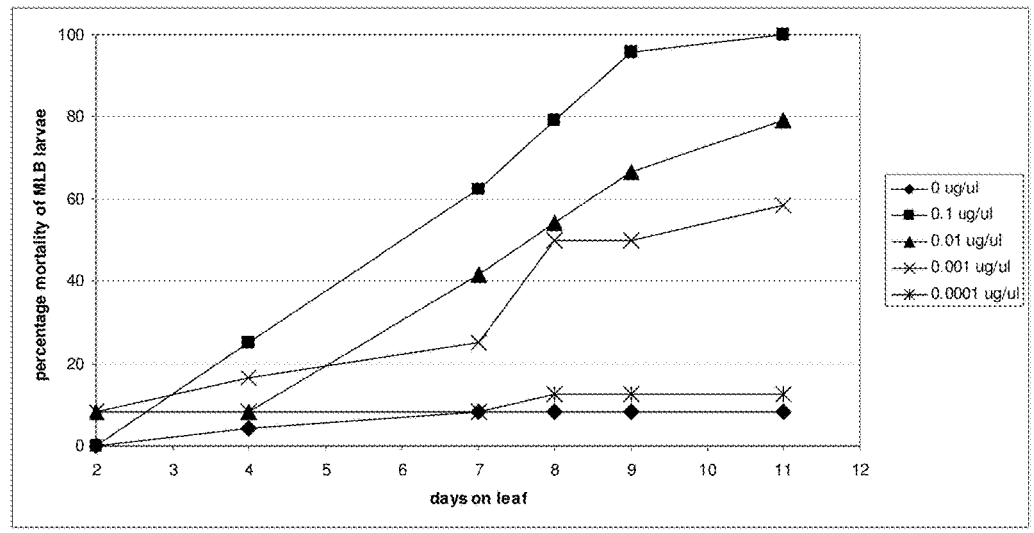
FIG. 17: Survival of *P. cochleariae* on oilseed rape leaf discs treated with different concentrations of dsRNA of (17A) target PC010 and (17B) target PC027. Neonate larvae were placed on leaf discs treated with 25 µl of topically-applied solution of dsRNA. Insects were transferred to fresh treated leaf discs at day 2. At day 4 for target PC010 and day 5 for target PC027, the insects were transferred to untreated leaves. The number of surviving insects were assessed at days 2, 4, 7, 8, 9 & 11 for PC010 and 2, 5, 8, 9 & 12 for PC027. The percentage of surviving larvae was calculated relative to day 0 (start of assay).
Figure 17B:
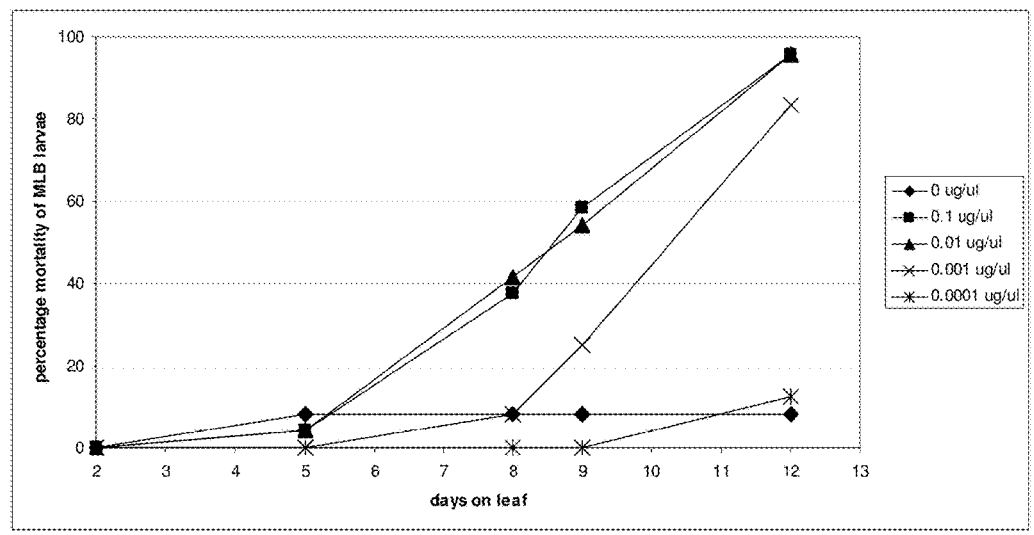

Larval survivors were assessed based on their average weight. For all targets tested, the mustard leaf beetle larvae had significantly reduced average weights after day 4 of the bioassay; insects fed control gfp dsRNA or 0.05% Triton X-100 alone developed normally, as for the larvae on leaf only (FIG. 16B).

D. Laboratory Trials to Screen dsRNAs at Different Concentrations Using Oilseed Rape Leaf Discs for Activity Against *Phaedon cochleariae* Larvae Twenty-five μl of a solution of dsRNA from target PC010 or PC027 at serial ten-fold concentrations from 0.1 μg/μl down to 0.1 ng/μl was applied topically onto the oilseed rape leaf disc, as described in Example 4D above. As a negative control, 0.05% Triton X-100 only was administered to the leaf disc. Per treatment, twenty-four mustard leaf beetle neonate larvae, with two insects per well, were tested. The plates were stored in the insect rearing chamber at 25±2° C., 60±5% relative humidity, with a 16:8 hours light:dark photoperiod. At day 2, the larvae were transferred on to a new plate containing fresh dsRNA-treated leaf discs. At day 4 for target PC010 and day 5 for target PC027, insects from each replicate were transferred to a Petri dish containing abundant untreated leaf material. The beetles were assessed as live or dead on days 2, 4, 7, 8, 9, and 11 for target PC010, and 2, 5, 8, 9 and 12 for target PC027.

Figure 2:
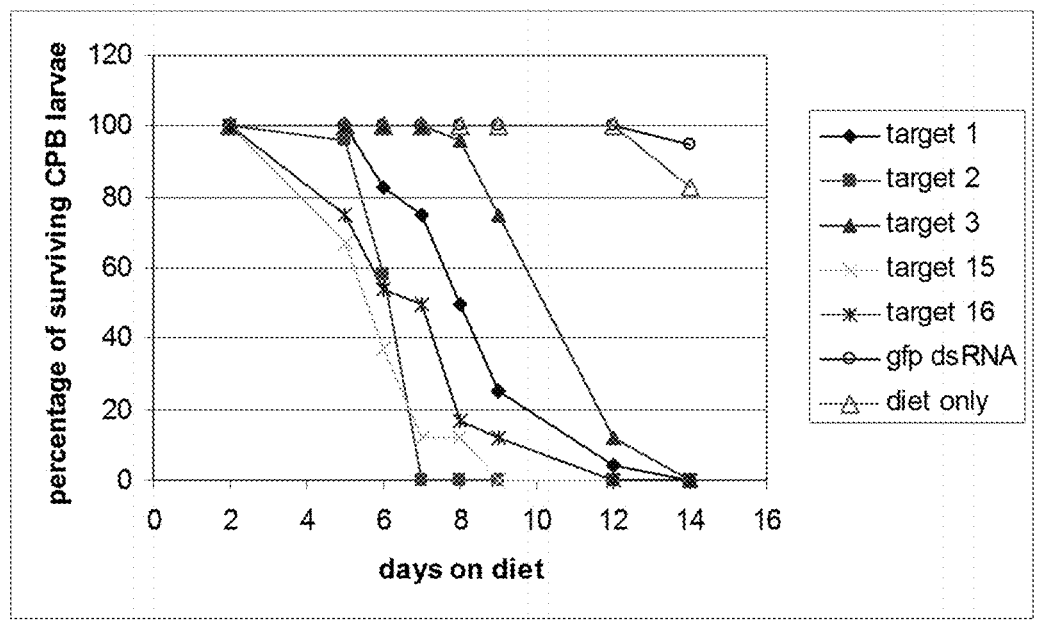
FIG. 2: Survival of L. decemlineata on artificial diet treated with dsRNA. Insects of the second larval stage were fed diet treated with 50 µl of topically-applied solution of dsRNA (targets or gfp control). Diet was replaced with fresh diet only after 7 days. The number of surviving insects was assessed at days 2, 5, 6, 7, 8, 9, 12, & 14. The percentage of surviving larvae was calculated relative to day 0 (start of assay). Target LD001 (SEQ ID NO: 163); Target LD002 (SEQ ID NO: 168); Target LD003 (SEQ ID NO: 173); Target LD015 (SEQ ID NO: 215); Target LD016 (SEQ ID NO: 220); gfp dsRNA (SEQ ID NO: 235).

Feeding oilseed rape leaf discs containing intact naked dsRNAs of the two different targets, PC010 and PC027, to *P. cochleariae* larvae resulted in high mortalities at concentrations down to as low as 1 ng dsRNA/μl solution, as shown in FIGS. 2 (*a*) and (*b*). Average mortality values in percentage±confidence interval with alpha 0.05 for different concentrations of dsRNA for target PC010 at day 11, 0 μg/μl:

8.3±9.4; 0.1 μg/μl: 100; 0.01 μg/μl: 79.2±20.6; 0.001 μg/μl: 58.3±9.4; 0.0001 μg/μl: 12.5±15.6; and for target PC027 at day 12, 0 μg/μl: 8.3±9.4; 0.1 μg/μl: 95.8±8.2; 0.01 μg/μl: 95.8±8.2; 0.001 μg/μl: 83.3±13.3; 0.0001 μg/μl: 12.5±8.2.

E. Cloning of a MLB Gene Fragment in a Vector Suitable for Bacterial Production of Insect-Active Double-Stranded RNA What follows is an example of cloning a DNA fragment corresponding to an MLB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8. The recombinant vector harbouring this sequence is named pGBNJ00 (to be completed).

The sequences of the specific primers used for the amplification of target gene fragment PC010 are provided in Table 8-PC. The template used was the pCR8/GW/topo vector containing the PC010 sequence (SEQ ID NO: 253). The primers were used in a touchdown PCR reaction with the following conditions: 1 minute at 95° C., followed by 20 cycles of 30 seconds at 95° C., 30 seconds at 60° C. with temperature decrease of −0.5° C. per cycle and 1 minute at 72° C., followed by 15 cycles of 30 seconds at 95° C., 30 seconds at 50° C. and 1 minute at 72° C., followed by 10 minutes at 72° C. The resulting PCR fragment was analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to SEQ ID NO: 488 as given in Table 8-PC. The recombinant vector harbouring this sequence was named pGCDJ001.

F. Expression and Production of a Double-Stranded RNA Target in Two Strains of *Escherichia coli* AB309-105

The procedures described below are followed in order to express suitable levels of insect-active double-stranded RNA of insect target in bacteria. In this experiment, an RNaseIII-deficient strain, AB309-105 is used.

Transformation of AB309-105

Three hundred ng of the plasmid were added to and gently mixed in a 50 μl aliquot of ice-chilled chemically competent *E. coli* strain AB309-105. The cells were incubated on ice for 20 minutes before subjecting them to a heat shock treatment of 37° C. for 5 minutes, after which the cells were placed back on ice for a further 5 minutes. Four hundred and fifty μl of room temperature SOC medium was added to the cells and the suspension incubated on a shaker (250 rpm) at 37° C. for 1 hour. One hundred μl of the bacterial cell suspension was transferred to a 500 ml conical flask containing 150 ml of liquid Luria-Bertani (LB) broth supplemented with 100 μg/ml carbenicillin antibiotic. The culture was incubated on an Innova 4430 shaker (250 rpm) at 37° C. overnight (16 to 18 hours).

Chemical Induction of Double-Stranded RNA Expression in AB309-105

Expression of double-stranded RNA from the recombinant vector, pGBNJ003, in the bacterial strain AB309-105 was made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture was measured using an appropriate spectrophotometer and adjusted to a value of 1 by the addition of fresh LB broth. Fifty ml of this culture was transferred to a 50 ml Falcon tube and the culture then centrifuged at 3000 g at 15° C. for 10 minutes. The supernatant was removed and the bacterial pellet resuspended in 50 ml of fresh S complete medium (SNC medium plus 5 μg/ml cholesterol) supplemented with 100 μg/ml carbenicillin and 1 mM IPTG. The bacteria were induced for 2 to 4 hours at room temperature.

Heat Treatment of Bacteria

Bacteria were killed by heat treatment in order to minimize the risk of contamination of the artificial diet in the test plates. However, heat treatment of bacteria expressing double-stranded RNA is not a prerequisite for inducing toxicity towards the insects due to RNA interference. The induced bacterial culture was centrifuged at 3000 g at room temperature for 10 minutes, the supernatant discarded and the pellet subjected to 80° C. for 20 minutes in a water bath. After heat treatment, the bacterial pellet was resuspended in a total volume of 50 ml of 0.05% Triton X-100 solution. The tube was stored at 4° C. until further use

G. Laboratory Trials to Test *Escherichia coli* Expressing dsRNA Targets Against *Phaedon cochleariae*

Leaf Disc Bioassays

The leaf-disc bioassay method was employed to test double-stranded RNA from target PC010 produced in *Escherichia coli* (from plasmid pGCDJ001) against larvae of the mustard leaf beetle. Leaf discs were prepared from oilseed rape foliage, as described in Example 4. Twenty μl of a bacterial suspension, with an optical density measurement of 1 at 600 nm wavelength, was pipetted onto each disc. The leaf disc was placed in a well of a 24-multiwell plate containing 1 ml gellified agar. On each leaf disc were added two neonate larvae. For each treatment, 3 replicates of 16 neonate larvae per replicate were prepared. The plates were kept in the insect rearing chamber at 25±2° C. and 60±5% relative humidity, with a 16:8 hours light:dark photoperiod. At day 3 (i.e. 3 days post start of bioassay), larvae were transferred to a new plate containing fresh treated (same dosage) leaf discs. The leaf material was refreshed every other day from day 5 onwards. The bioassay was scored on mortality and average weight. Negative controls were leaf discs treated with bacteria harbouring plasmid pGN29 (empty vector) and leaf only.

Figure 18:
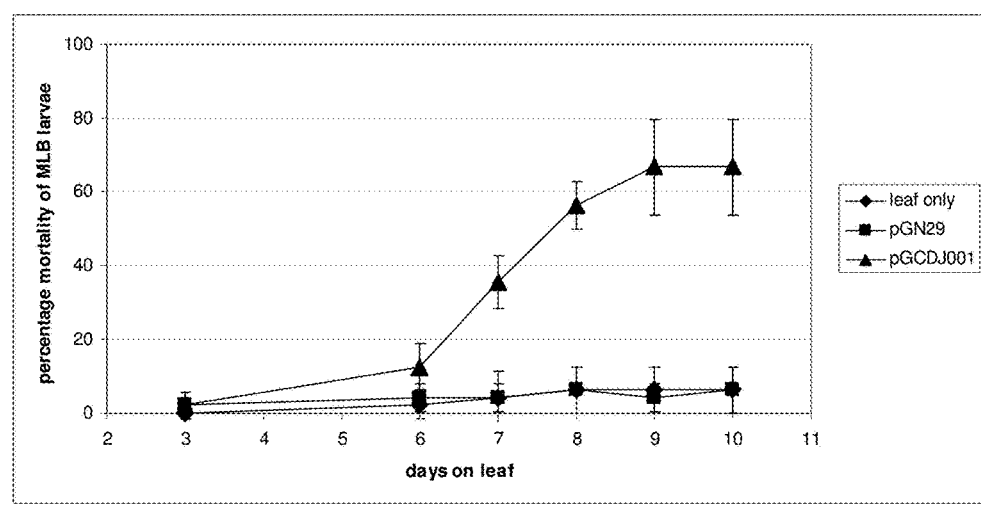
FIG. 18: Effects of *E. coli* strain AB309-105 expressing dsRNA target PC010 on survival of larvae of the mustard leaf beetle, *P. cochleariae*, over time. Data points for each treatment represent average mortality values from 3 different replicates. Error bars represent standard deviations. Target 10: SEQ ID NO: 488

A clear increase in mortality of *P. cochleariae* larvae with time was shown after the insects were fed on oilseed rape leaves treated with a suspension of RNaseIII-deficient *E. coli* strain AB309-105 containing plasmid pGCDJ001, whereas very little or no insect mortality was observed in the case of bacteria with plasmid pGN29 or leaf only control (FIG. 18).

Plant-Based Bioassays

Whole plants are sprayed with suspensions of chemically induced bacteria expressing dsRNA prior to feeding the plants to MLB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. MLB are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 5: *Epilachna varivetis* (Mexican Bean Beetle)

A. Cloning *Epilachna varivetis* Partial Gene Sequences

High quality, intact RNA was isolated from 4 different larval stages of *Epilachna varivetis* (Mexican bean beetle; source: Thomas Dorsey, Supervising Entomologist, New Jersey Department of Agriculture, Division of Plant Industry, Bureau of Biological Pest Control, Phillip Alampi Beneficial Insect Laboratory, PO Box 330, Trenton, N.J. 08625-0330, USA) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the EV005, EV009, EV010, EV015 and EV016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-EV, which displays *Epilachna varivetis* target genes including primer sequences and cDNA sequences obtained. These primers were used in respective PCR reactions with the following conditions: for EV005 and EV009, 10 minutes at 95° C., followed by 40 cycles of 30 seconds at 95° C., 1 minute at 50° C. and 1 minute 30 seconds at 72° C., followed by 7 minutes at 72° C.; for EV014, 10 minutes at 95° C., followed by 40 cycles of 30 seconds at 95° C., 1 minute at 53° C. and 1 minute at 72° C., followed by 7 minutes at 72° C.; for EV010 and EV016, 10 minutes at 95° C., followed by 40 cycles of 30 seconds at 95° C., 1 minute at 54° C. and 1 minute 40 seconds at 72° C., followed by 7 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K4530-20, Invitrogen), and sequenced. The sequences of the resulting PCR products are represented by the respective SEQ ID NO:s as given in Table 2-EV and are referred to as the partial sequences. The corresponding partial amino acid sequences are represented by the respective SEQ ID NO:s as given in Table 3-EV, where the start of the reading frame is indicated in brackets.

B. dsRNA Production of the *Epilachna varivetis* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-EV.

The conditions in the PCR reactions were as follows: 1 minute at 95° C., followed by 20 cycles of 30 seconds at 95° C., 30 seconds at 60° C. and 1 minute at 72° C., followed by 15 cycles of 30 seconds at 95° C., 30 seconds at 50° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-EV. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-EV.

C. Laboratory Trials to Test dsRNA Targets Using Bean Leaf Discs for Activity Against *Epilachna varivetis* Larvae The example provided below is an exemplification of the finding that the Mexican bean beetle (MBB) larvae are susceptible to orally ingested dsRNA corresponding to own target genes.

To test the different double-stranded RNA samples against MBB larvae, a leaf disc assay was employed using snap bean (*Phaseolus vulgaris* variety Montano; source: Aveve NV, Belgium) leaf material as food source. The same variety of beans was used to maintain insect cultures in the insect chamber at 25±2° C. and 60±5% relative humidity with a photoperiod of 16 h light/8 h dark. Discs of approximately 1.1 cm in diameter (or 0.95 cm$^2$) were cut out off leaves of 1- to 2-week old bean plants using a suitably-sized cork borer. Double-stranded RNA samples were diluted to 1 µg/µl in Milli-Q water containing 0.05% Triton X-100. Treated leaf discs were prepared by applying 25 µl of the diluted solution of target Ev005, Ev010, Ev015, Ev016 dsRNA and control gfp dsRNA or 0.05% Triton X-100 on the adaxial leaf surface. The leaf discs were left to dry and placed individually in each of the 24 wells of a 24-well multiplate containing 1 ml of gellified 2% agar which helps to prevent the leaf disc from drying out. A single neonate MBB larva was placed into each well of a plate, which was then covered with a multiwell plastic lid. The plate was divided into 3 replicates of 8 insects per replicate (row). The plate containing the insects and leaf discs were kept in an insect chamber at 25±2° C. and 60±5% relative humidity with a photoperiod of 16 h light/8 h dark. The insects were fed on the leaf discs for 2 days after which the insects were transferred to a new plate containing freshly treated leaf discs. Thereafter, 4 days after the start of the bioassay, the insects were transferred to a petriplate containing untreated fresh bean leaves every day until day 10. Insect mortality was recorded at day 2 and every other day thereafter.

Figure 19:
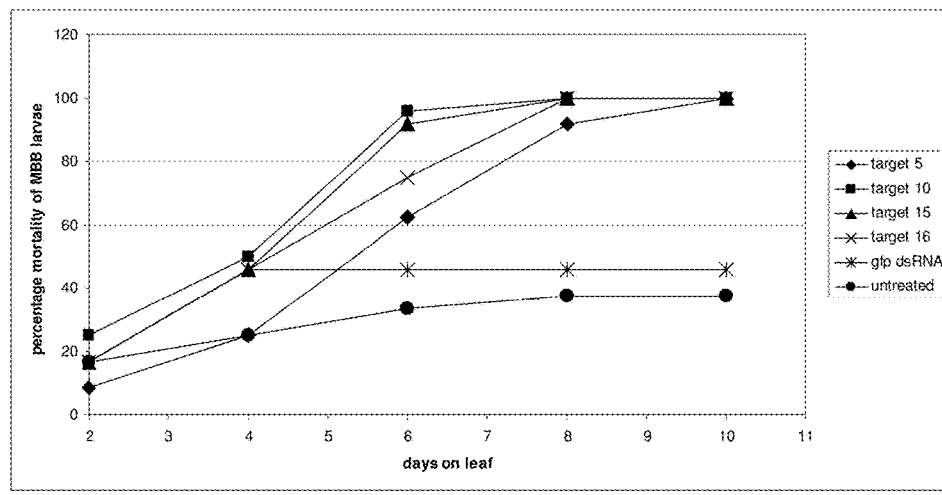
FIG. 19: Survival of *E. varivestis* larvae on bean leaf discs treated with dsRNA. Neonate larvae were fed bean leaf discs treated with 25 µl of topically-applied solution of 1 µg/µl dsRNA (targets or gfp control). After 2 days, the insects were transferred onto fresh dsRNA-treated leaf discs. At day 4, larvae from one treatment were collected and placed in a plastic box containing fresh untreated bean foliage. The insects were assessed for mortality at days 2, 4, 6, 8 & 10. The percentage of surviving larvae was calculated relative to day 0 (start of assay). Target 5: SEQ ID NO: 576; target 10: SEQ ID NO: 586; target 15: SEQ ID NO: 591; target 16: SEQ ID NO: 596; gfp dsRNA: SEQ ID NO: 235.

Feeding snap bean leaves containing surface-applied intact naked target dsRNAs to *E. varivestis* larvae resulted in significant increases in larval mortalities, as indicated in FIG. 1. Tested double-stranded RNAs of targets Ev010, Ev015, & Ev016 led to 100% mortality after 8 days, whereas dsRNA of target Ev005 took 10 days to kill all larvae. The majority of the insects fed on treated leaf discs containing control gfp dsRNA or only the surfactant Triton X-100 were sustained throughout the bioassay (FIG. 19).

D. Laboratory Trials to Test dsRNA Targets Using Bean Leaf Discs for Activity Against *Epilachna varivestis* Adults The example provided below is an exemplification of the finding that the Mexican bean beetle adults are susceptible to orally ingested dsRNA corresponding to own target genes.

In a similar bioassay set-up as for Mexican bean beetle larvae, adult MBBs were tested against double-stranded RNAs topically-applied to bean leaf discs. Test dsRNA from each target Ev010, Ev015 and Ev016 was diluted in 0.05% Triton X-100 to a final concentration of 0.1 µg/µl. Bean leaf discs were treated by topical application of 30 µl of the test solution onto each disc. The discs were allowed to dry completely before placing each on a slice of gellified 2% agar in each well of a 24-well multiwell plate. Three-day-old adults were collected from the culture cages and fed nothing for 7-8 hours prior to placing one adult to each well of the bioassay plate (thus 24 adults per treatment). The plates were kept in the insect rearing chamber (under the same conditions as for MBB larvae for 24 hours) after which the adults were transferred to a new plate containing fresh dsRNA-treated leaf discs. After a further 24 hours, the adults from each treatment were collected and placed in a plastic box with dimensions 30 cm×15 cm×10 cm containing two potted and untreated 3-week-old bean plants. Insect mortality was assessed from day 4 until day 11.

Figure 20A:
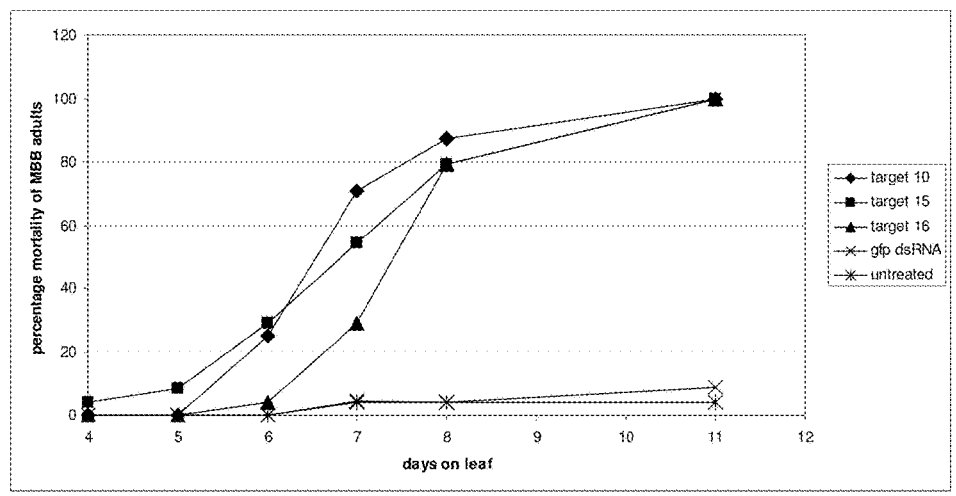
Figure 20B:
Figure 20C:
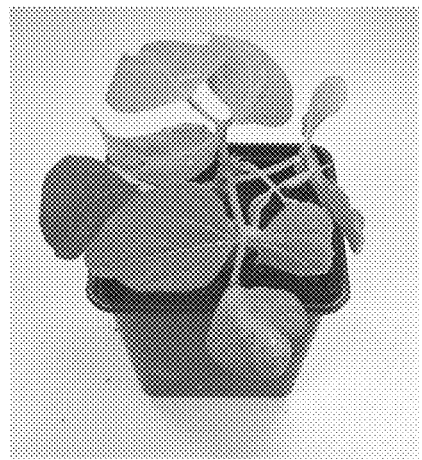
Figure 20D:
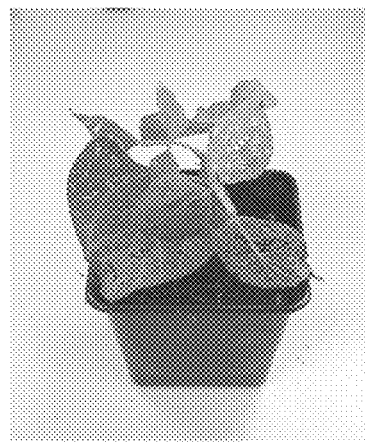
Figure 20E:
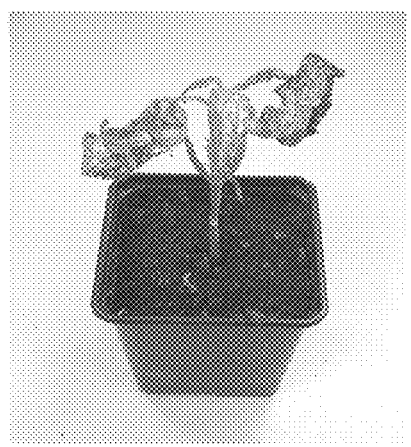
Figure 20F:
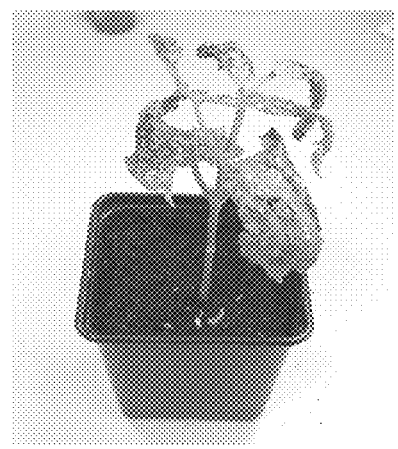
Figure 21:
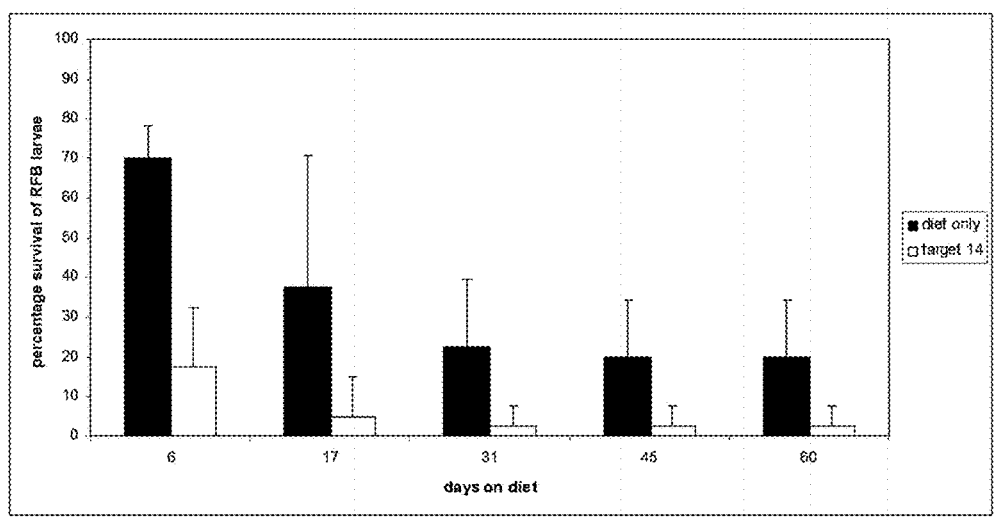
Figure 22:
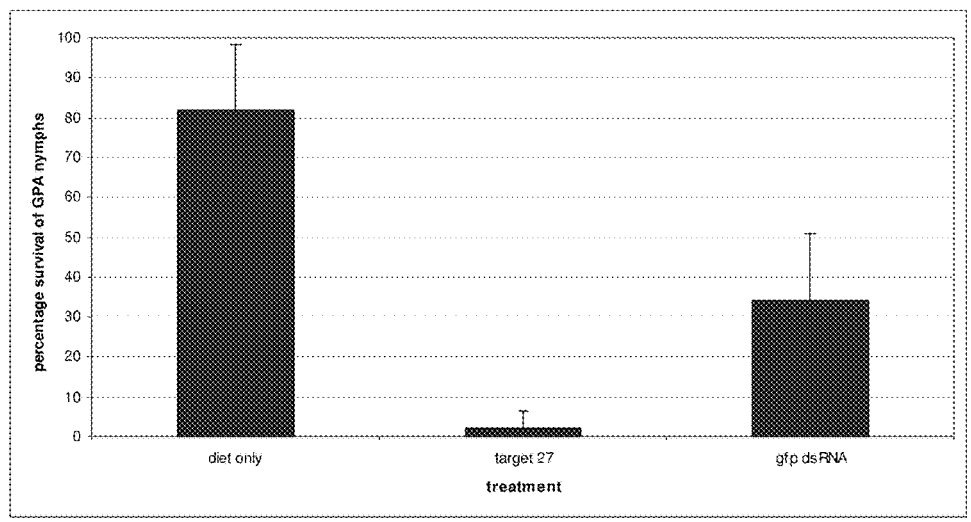
Figure 23A:
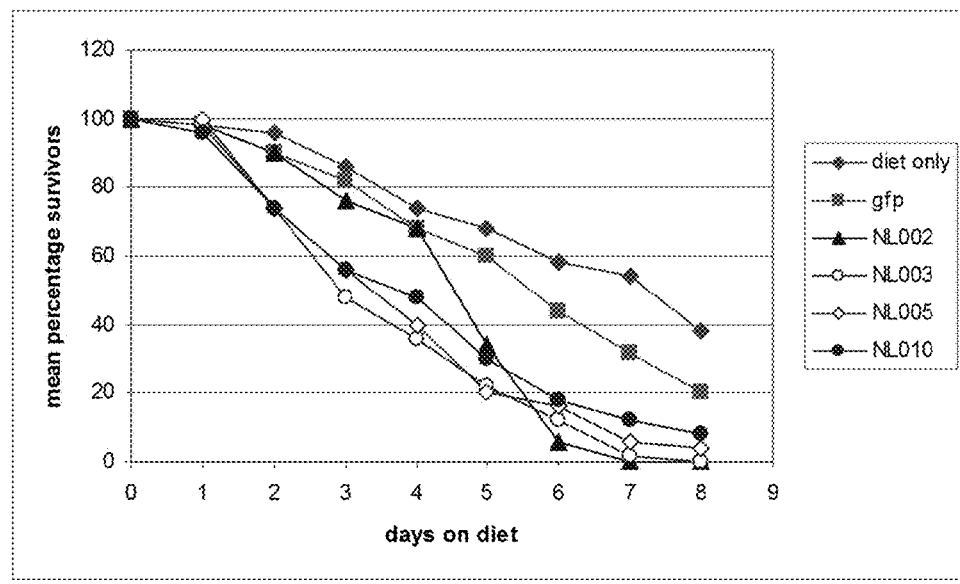
Figure 23B:
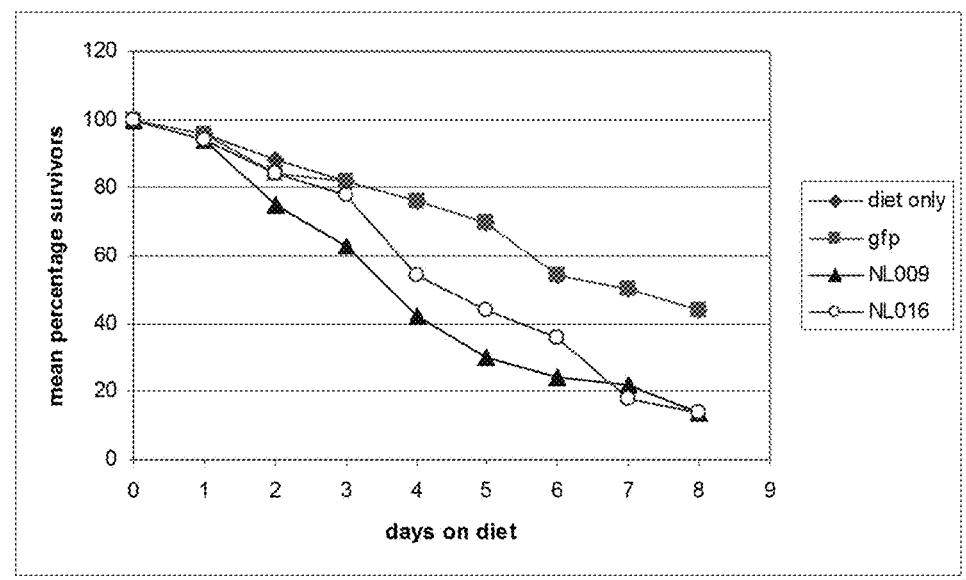
Figure 23C:
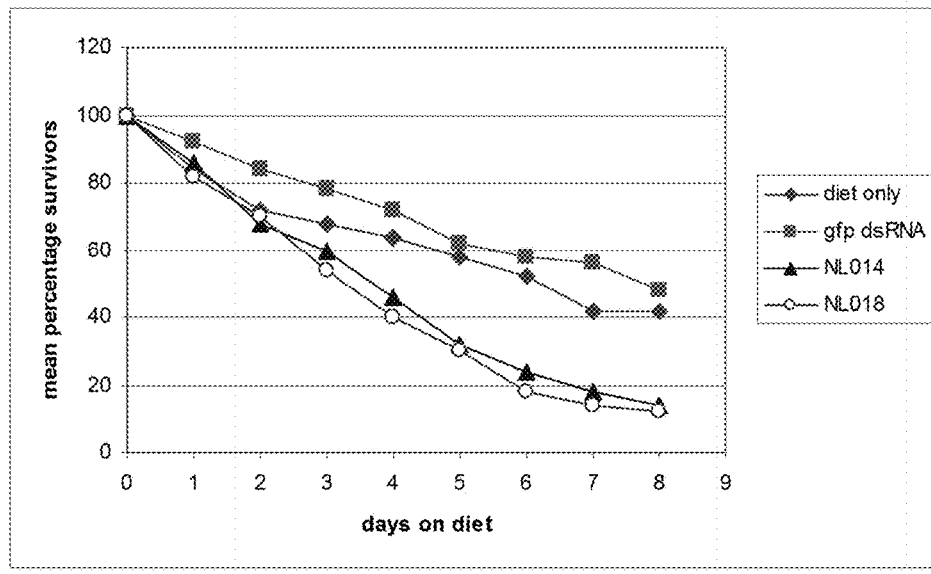
Figure 23D:
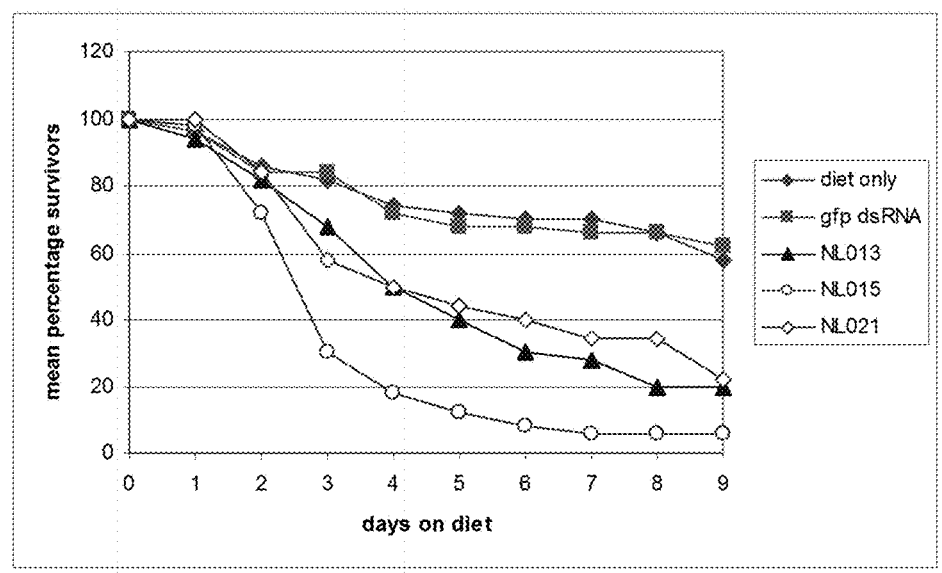

All three target dsRNAs (Ev010, Ev015 and Ev016) ingested by adults of *Epilachna varivestis* resulted in significant increases in mortality from day 4 (4 days post bioassay start), as shown in FIG. 20A. From day 5, dramatic changes in feeding patterns were observed between insects fed initially with target-dsRNA-treated bean leaf discs and those that were fed discs containing control gfp dsRNA or surfactant Triton X-100. Reductions in foliar damage by MBB adults of untreated bean plants were clearly visible for all three targets when compared to gfp dsRNA and surfactant only controls, albeit at varying levels; insects fed target 15 caused the least damage to bean foliage (FIGS. 20B-20F)

E. Cloning of a MBB Gene Fragment in a Vector Suitable for Bacterial Production of Insect-Active Double-Stranded RNA What follows is an example of cloning a DNA fragment corresponding to an MLB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-EV. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-EV. The recombinant vector harbouring this sequence is named pGBNJ00XX.

F. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 μl aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimize the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

G. Laboratory Trials to Test *Escherichia coli* Expressing dsRNA Targets Against *Epilachna varivetis*

Plant-Based Bioassays

Whole plants are sprayed with suspensions of chemically induced bacteria expressing dsRNA prior to feeding the plants to MBB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. MMB are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 6: *Anthonomus grandis* (Cotton Boll Weevil)

A. Cloning *Anthonomus grandis* Partial Sequences

High quality, intact RNA was isolated from the 3 instars of *Anthonomus grandis* (cotton boll weevil; source: Dr. Gary Benzon, Benzon Research Inc., 7 Kuhn Drive, Carlisle, Pa. 17013, USA) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the AG001, AG005, AG010, AG014 and AG016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-AG. These primers were used in respective PCR reactions with the following conditions: for AG001, AG005 and AG016, 10 minutes at 95° C., followed by 40 cycles of 30 seconds at 95° C., 1 minute at 50° C. and 1 minute and 30 seconds at 72° C., followed by 7 minutes at 72° C.; for AG010, 10 minutes at 95° C., followed by 40 cycles of 30 seconds at 95° C., 1 minute at 54° C. and 2 minutes and 30 seconds at 72° C., followed by 7 minutes at 72° C.; for AG014, 10 minutes at 95° C., followed by 40 cycles of 30 seconds at 95° C., 1 minute at 55° C. and 1 minute at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen) and sequenced. The sequences of the resulting PCR products are represented by the respective SEQ ID NO:s as given in Table 2-AG and are referred to as the partial sequences. The corresponding partial amino acid sequence are represented by the respective SEQ ID NO:s as given in Table 3-AG.

B. dsRNA Production of the *Anthonomus grandis* (Cotton Boll Weevil) Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-AG. A touchdown PCR was performed as follows: 1 minute at 95° C., followed by 20 cycles of 30 seconds at 95° C., 30 seconds at 60° C. with a decrease in temperature of 0.5° C. per cycle and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-AG. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-AG.

C. Laboratory Trials to Test dsRNA Targets, Using Artificial Diet for Activity Against the Larvae of the House Cricket, *Acheta domesticus*

House crickets, *Acheta domesticus*, were maintained at Insect Investigations Ltd. (origin: Blades Biological Ltd., Kent, UK). The insects were reared on bran pellets and cabbage leaves. Mixed sex nymphs of equal size and no more than 5 days old were selected for use in the trial. Double-stranded RNA was mixed with a wheat-based pelleted rodent diet (rat and mouse standard diet, B & K Universal Ltd., Grimston, Aldbrough, Hull, UK). The diet, BK001P, contains the following ingredients in descending order by weight: wheat, soya, wheatfeed, barley, pellet binder, rodent 5 vit min, fat blend, dicalcium phosphate, mould carb. The pelleted rodent diet was finely ground and heat-treated in a microwave oven prior to mixing, in order to inactivate any enzyme components. All rodent diet was taken from the same batch in order to ensure consistency. The ground diet and dsRNA were mixed thoroughly and formed into small pellets of equal weight, which were allowed to dry overnight at room temperature.

Double-stranded RNA samples from targets and gfp control at concentrations 10 μg/μl are applied in the ratio 1 g ground diet plus 1 ml dsRNA solution, thereby resulting in an application rate of 10 mg dsRNA per g pellet. Pellets are replaced weekly. The insects are provided with treated pellets for the first three weeks of the trial. Thereafter untreated pellets are provided. Insects are maintained within lidded plastic containers (9 cm diameter, 4.5 cm deep), ten per container. Each arena contains one treated bait pellet and one water source (damp cotton wool ball), each placed in a separate small weigh boat. The water is replenished ad lib throughout the experiment.

Assessments are made at twice weekly intervals, with no more than four days between assessments, until all the control insects had either died or moulted to the adult stage (84 days). At each assessment the insects are assessed as live or dead, and examined for abnormalities. From day 46 onwards, once moulting to adult commences, all insects (live and dead) are assessed as nyumph or adult. Surviving insects are weighed on day 55 of the trial. Four replicates are performed for each of the treatments. During the trial the test conditions are 25 to 33° C. and 20 to 25% relative humidity, with a 12:12 hour light:dark photoperiod.

D. Cloning of a MLB Gene Fragment in a Vector Suitable for Bacterial Production of Insect-Active Double-Stranded RNA What follows is an example of cloning a DNA fragment corresponding to an MLB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8. The recombinant vector harbouring this sequence is named pGBNJ00XX.

E. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 μl aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Anthonomus grandis*

Plant-Based Bioassays

Whole plants are sprayed with suspensions of chemically induced bacteria expressing dsRNA prior to feeding the plants to CBW. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. CBW are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 7: *Tribolium castaneum* (Red Flour Beetle)

A. Cloning *Tribolium castaneum* Partial Sequences

High quality, intact RNA was isolated from all the different insect stages of *Tribolium castaneum* (red flour beetle; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the TC001, TC002, TC010, TC014 and TC015 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-TC. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. (TC001, TC014, TC015); 10 minutes at 95° C., followed by 40 cycles of 30 seconds at 95° C., 1 minute at 54° C. and 2 minutes and 30 seconds at 72° C., followed by 7 minutes at 72° C. (TC010); 10 minutes at 95° C., followed by 40 cycles of 30 seconds at 95° C., 1 minute at 53° C. and 1 minute at 72° C., followed by 7 minutes at 72° C. (TC002). The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen), and sequenced. The sequences of the resulting PCR products are represented by the respective SEQ ID NO:s as given in Table 2-TC and are referred to as the partial sequences. The corresponding partial amino acid sequences are represented by the respective SEQ ID NO:s as given in Table 3-TC.

B. dsRNA Production of the *Tribolium castaneum* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-TC. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-TC. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-TC.

C. Laboratory Trials to Test dsRNA Targets, Using Artificial Diet for Activity Against *Tribolium castaneum* Larvae The example provided below is an exemplification of the finding that the red flour beetle (RFB) larvae are susceptible to orally ingested dsRNA corresponding to own target genes.

Red flour beetles, *Tribolium castaneum*, were maintained at Insect Investigations Ltd. (origin: Imperial College of Science, Technology and Medicine, Silwood Park, Berkshire, UK). Insects were cultured according to company SOP/251/01. Briefly, the beetles were housed in plastic jars or tanks. These have an open top to allow ventilation. A piece of netting was fitted over the top and secured with an elastic band to prevent escape. The larval rearing medium (flour) was placed in the container where the beetles can breed. The stored product beetle colonies were maintained in a controlled temperature room at 25±3° C. with a 16:8 hour light:dark cycle.

Double-stranded RNA from target TC014 (with sequence corresponding to SEQ ID NO: 799) was incorporated into a mixture of flour and milk powder (wholemeal flour: powdered milk in the ratio 4:1) and left to dry overnight. Each replicate was prepared separately: 100 μA of a 10 μg/μl dsRNA solution (1 mg dsRNA) was added to 0.1 g flour/milk mixture. The dried mixture was ground to a fine powder. Insects were maintained within Petri dishes (55 mm diameter), lined with a double layer of filter paper. The treated diet was placed between the two filter paper layers. Ten first instar, mixed sex larvae were placed in each dish (replicate). Four replicates were performed for each treatment. Control was Milli-Q water. Assessments (number of survivors) were made on a regular basis. During the trial, the test conditions were 25-33° C. and 20-25% relative humidity, with a 12:12 hour light:dark photoperiod.

Survival of larvae of *T. castaneum* over time on artificial diet treated with target TC014 dsRNA was significantly reduced when compared to diet only control, as shown in FIG. 1.

D. Cloning of a RFB Gene Fragment in a Vector Suitable for Bacterial Production of Insect-Active Double-Stranded RNA What follows is an example of cloning a DNA fragment corresponding to an RFB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-TC. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-TC. The recombinant vector harbouring this sequence is named pGBNJ00 XX.

E. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 μl aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Tribolium castaneum*

Plant-Based Bioassays

Whole plants are sprayed with suspensions of chemically induced bacteria expressing dsRNA prior to feeding the plants to RFB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. RFB are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 10*: Myzus persicae* (Green Peach Aphid)

A. Cloning *Myzus persicae* Partial Sequences

High quality, intact RNA was isolated from nymphs of *Myzus persicae* (green peach aphid; source: Dr. Rachel Down, Insect & Pathogen Interactions, Central Science Laboratory, Sand Hutton, York, YO41 1LZ, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the MP001, MP002, MP010, MP016 and MP027 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-MP. These primers were used in respective PCR reactions with the following conditions: for MP001, MP002 and MP016, 10 minutes at 95° C., followed by 40 cycles of 30 seconds at 95° C., 1 minute at 50° C. and 1 minute 30 seconds at 72° C., followed by 7 minutes at 72° C.; for MP027, a touchdown program was used: 10 minutes at 95° C., followed by 10 cycles of 30 seconds at 95° C., 40 seconds at 60° C. with a decrease in temperature of 1° C. per cycle and 1 minute 10 seconds at 72° C., followed by 30 cycles of 30 seconds at 95° C., 40 seconds at 50° C. and 1 minute 10 seconds at 72° C., followed by 7 minutes at 72° C.; for MP010, 10 minutes at 95° C., followed by 40 cycles of 30 seconds at 95° C., 1 minute at 54° C. and 3 minutes at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen), and sequenced. The sequences of the resulting PCR products are represented by the respective SEQ ID NO:s as given in Table 2-MP and are referred to as the partial sequences. The corresponding partial amino acid sequences are represented by the respective SEQ ID NO:s as given in Table 3-MP.

B. dsRNA Production of *Myzus persicae* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-MP. A touchdown PCR was performed as follows: 1 minute at 95° C., followed by 20 cycles of 30 seconds at 95° C., 30 seconds at 55° C. (for MP001, MP002, MP016, MP027 and gfp) or 30 seconds at 50° C. (for MP010) with a decrease in temperature of 0.5° C. per cycle and 1 minute at 72° C., followed by 15 cycles of 30 seconds at 95° C., 30 seconds at 45° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-MP. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-MP.

C. Laboratory Trials to Test dsRNA Targets Using Liquid Artificial Diet for Activity Against *Myzus persicae*

Liquid artificial diet for the green peach aphid, *Myzus persicae*, was prepared based on the diet suitable for pea aphids (*Acyrthosiphon pisum*), as described by Febvay et al. (1988) [Influence of the amino acid balance on the improvement of an artificial diet for a biotype of *Acyrthosiphon pisum* (Homoptera: Aphididae). *Can. J. Zool.* 66: 2449-2453], but with some modifications. The amino acids component of the diet was prepared as follows: in mg/100 ml, alanine 178.71, beta-alanine 6.22, arginine 244.9, asparagine 298.55, aspartic acid 88.25, cysteine 29.59, glutamic acid 149.36, glutamine 445.61, glycine 166.56, histidine 136.02, isoleucine 164.75, leucine 231.56, lysine hydrochloride 351.09, methionine 72.35, ornithine (HCl) 9.41, phenylalanine 293, proline 129.33, serine 124.28, threonine 127.16, tryptophane 42.75, tyrosine 38.63, L-valine 190.85. The amino acids were dissolved in 30 ml Milli-Q $H_2O$ except for tyrosine which was first dissolved in a few drops of 1 M HCl before adding to the amino acid mix. The vitamin mix component of the diet was prepared as a 5× concentrate stock as follows: in mg/L, amino benzoic acid 100, ascorbic acid 1000, biotin 1, calcium panthothenate 50, choline chloride 500, folic acid 10, myoinositol 420, nicotinic acid 100, pyridoxine hydrochloride 25, riboflavin 5, thiamine hydrochloride 25. The riboflavin was dissolved in 1 ml H2O at 50° C. and then added to the vitamin mix stock. The vitamin mix was aliquoted in 20 ml per aliquot and stored at −20° C. One aliquot of vitamin mix was added to the amino acid solution. Sucrose and $MgSO_4.7H_2O$ was added with the following amounts to the mix: 20 g and 242 mg, respectively. Trace metal stock solution was prepared as follows: in mg/100 ml, $CuSO_4.5H_2O$ 4.7, $FeCl_3.6H_2O$ 44.5, $MnCl_2$.4H2O 6.5, NaCl 25.4, $ZnCl_2$ 8.3. Ten ml of the trace metal solution and 250 mg $KH_2PO_4$ was added to the diet and Milli-Q water was added to a final liquid diet volume of 100 ml. The pH of the diet was adjusted to 7 with 1 M KOH solution. The liquid diet was filter-sterilised through an 0.22 μm filter disc (Millipore).

Green peach aphids (*Myzus persicae*; source: Dr. Rachel Down, Insect & Pathogen Interactions, Central Science Laboratory, Sand Hutton, York, YO41 1LZ, UK) were reared on 4- to 6-week-old oilseed rape (*Brassica napus* variety SW Oban; source: Nick Balaam, Sw Seed Ltd., 49 North Road, Abington, Cambridge, CB1 6AS, UK) in aluminium-framed cages containing 70 μm mesh in a controlled environment chamber with the following conditions: 23±2° C. and 60±5% relative humidity, with a 16:8 hours light:dark photoperiod.

One day prior to the start of the bioassay, adults were collected from the rearing cages and placed on fresh detached oilseed rape leaves in a Petri dish and left overnight in the insect chamber. The following day, first-instar nymphs were picked and transferred to feeding chambers. A feeding chamber comprised of 10 first instar nymphs placed in a small Petri dish (with diameter 3 cm) covered with a single layer of thinly stretched parafilm M onto which 50 μl of diet was added. The chamber was sealed with a second layer of parafilm and incubated under the same conditions as the adult cultures. Diet with dsRNA was refreshed every other day and the insects' survival assessed on day 8 i.e. $8^{th}$ day post bioassay start. Per treatment, 5 bioassay feeding chambers (replicates) were set up simultaneously. Test and control (gfp) dsRNA solutions were incorporated into the diet to a final concentration of 2 μg/μl. The feeding chambers were kept at 23±2° C. and 60±5% relative humidity, with a 16:8 hours light:dark photoperiod. A Mann-Whitney test was determined by GraphPad Prism version 4 to establish whether the medians do differ significantly between target 27 (MP027) and gfp dsRNA.

In the bioassay, feeding liquid artificial diet supplemented with intact naked dsRNA from target 27 (SEQ ID NO: 1061) to nymphs of *Myzus persicae* using a feeding chamber, resulted in a significant increase in mortality, as shown in FIG. 1. Average percentage survivors for target 27, gfp dsRNA and diet only treatment were 2, 34 and 82, respectively. Comparison of target 027 with gfp dsRNA groups using the Mann-Whitney test resulted in an one-tailed P-value of 0.004 which indicates that the median of target 027 is significantly different (P<0.05) from the expected larger median of gfp dsRNA. The green peach aphids on the liquid diet with incorporated target 27 dsRNA were noticeably smaller than those that were fed on diet only or with gfp dsRNA control (data not presented).

D. Cloning of a GPA Gene Fragment in a Vector Suitable for Bacterial Production of Insect-Active Double-Stranded RNA What follows is an example of cloning a DNA fragment corresponding to a GPA gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-MP. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-MP. The recombinant vector harbouring this sequence is named pGBNJ00XX.

E. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 μA aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Myzus persicae*

Plant-Based Bioassays

Whole plants are sprayed with suspensions of chemically induced bacteria expressing dsRNA prior to feeding the plants to GPA. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. GPA are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 11: *Nilaparvata lugens* (Brown Plant Hopper)

A. Cloning *Nilaparvata lugens* Partial Sequences

From high quality total RNA of *Nilaparvata lugens* (source: Dr. J. A. Gatehouse, Dept. Biological Sciences, Durham University, UK) cDNA was generated using a commercially available kit (SuperScript™ III Reverse Transcriptase, Cat N°. 18080044, Invitrogen, Rockville, Md., USA) following the manufacturer's protocol.

To isolate cDNA sequences comprising a portion of the *Nilaparvata lugens* NL001, NL002, NL003, NL004, NL005, NL006, NL007, NL008, NL009, NL010, NL011, NL012, NL013, NL014, NL015, NL016, NL018, NL019, NL021, NL022, and NL027 genes, a series of PCR reactions with degenerate primers were performed using Amplitaq Gold (Cat N°. N8080240; Applied Biosystems) following the manufacturer's protocol.

The sequences of the degenerate primers used for amplification of each of the genes are given in Table 2-NL. These primers were used in respective PCR reactions with the following conditions: for NL001: 5 minutes at 95° C., followed by 40 cycles of 30 seconds at 95° C., 1 minute at 55° C. and 1 minute at 72° C., followed by 10 minutes at 72° C.: for NL002: 3 minutes at 95° C., followed by 40 cycles of 30 seconds at 95° C., 1 minute at 55° C. and 1 minute at 72° C., followed by 10 minutes at 72° C.; for NL003: 3 minutes at 95° C., followed by 40 cycles of 30 seconds at 95° C., 1 minute at 61° C. and 1 minute at 72° C., followed by 10 minutes at 72° C.; for NL004: 10 minutes at 95° C., followed by 40 cycles of 30 seconds at 95° C., 1 minute at 51° C. and 1 minute at 72° C.; for NL005: 10 minutes at 95° C., followed by 40 cycles of 30 seconds at 95° C., 1 minute at 54° C. and 1 minute at 72° C., followed by 10 minutes at 72° C.; for NL006: 10 minutes at 95° C., followed by 40 cycles of 30 seconds at 95° C., 1 minute at 55° C. and 3 minute 30 seconds at 72° C., followed by 10 minutes at 72° C.; for NL007: 10 minutes at 95° C., followed by 40 cycles of 30 seconds at 95° C., 1 minute at 54° C. and 1 minute 15 seconds at 72° C., followed by 10 minutes at 72° C.; for NL008: 10 minutes at 95° C., followed by 40 cycles of 30 seconds at 95° C., 1 minute at 53° C. and 1 minute at 72° C., followed by 10 minutes at 72° C.; for NL009: 10 minutes at 95° C., followed by 40 cycles of 30 seconds at 95° C., 1 minute at 55° C. and 1 minute at 72° C., followed by 10 minutes at 72° C.; for NL010: 10 minutes at 95° C., followed by 40 cycles of 30 seconds at 95° C., 1 minute at 54° C. and 2 minute 30 seconds at 72° C., followed by 10 minutes at 72° C.; for NL011: 10 minutes at 95° C., followed by 40 cycles of 30 seconds at 95° C., 1 minute at 55° C. and 1 minute at 72° C., followed by 10 minutes at 72° C.; for NL012: 10 minutes at 95° C., followed by 40 cycles of 30 seconds at 95° C., 1 minute at 55° C. and 1 minute at 72° C.; for NL013: 10 minutes at 95° C., followed by 40 cycles of 30 seconds at 95° C., 1 minute at 54° C. and 1 minute 10 seconds at 72° C., followed by 10 minutes at 72° C.; for NL014: 10 minutes at 95° C., followed by 40 cycles of 30 seconds at 95° C., 1 minute at 53° C. and 1 minute at 72° C., followed by 10 minutes at 72° C.; for NL015: 10 minutes at 95° C., followed by 40 cycles of 30 seconds at 95° C., 1 minute at 54° C. and 1 minute 40 seconds at 72° C., followed by 10 minutes at 72° C.; for NL016: 10 minutes at 95° C., followed by 40 cycles of 30 seconds at 95° C., 1 minute at 54° C. and 1 minute 40 seconds at 72° C., followed by 10 minutes at 72° C.; for NL018: 10 minutes at 95° C., followed by 40 cycles of 30 seconds at 95° C., 1 minute at 54° C. and 1 minute 35 seconds at 72° C., followed by 10 minutes at 72° C.; for NL019: 10 minutes at 95° C., followed by 40 cycles of 30 seconds at 95° C., 1 minute at 55° C. and 1 minute at 72° C., followed by 10 minutes at 72° C.; for NL021: 10 minutes at 95° C., followed by 40 cycles of 30 seconds at 95° C., 1 minute at 54° C. and 1 minute 45 seconds at 72° C., followed by 10 minutes at 72° C.: for NL022: 10 minutes at 95° C., followed by 40 cycles of 30 seconds at 95° C., 1 minute at 54° C. and 1 minute 45 seconds at 72° C., followed by 10 minutes at 72° C.; and for NL027: 10 minutes at 95° C., followed by 40 cycles of 30 seconds at 95° C., 1 minute at 54° C. and 1 minute 45 seconds at 72° C., followed by 10 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen), and sequenced. The sequences of the resulting PCR products are represented by the respective SEQ ID NO:s as given in Table 2-NL and are referred to as the partial sequences. The corresponding partial amino acid sequences are represented by the respective SEQ ID NO:s as given in Table 3-NL.

B. Cloning of a Partial Sequence of the *Nilaparvata lugens* NL023 Gene Via EST Sequence From high quality total RNA of *Nilaparvata lugens* (source: Dr. J. A. Gatehouse, Dept. Biological Sciences, Durham University, UK) cDNA was generated using a commercially available kit (SuperScript™ III Reverse Transcriptase, Cat N°. 18080044, Invitrogen, Rockville, Md., USA) following the manufacturer's protocol.

A partial cDNA sequence, NL023, was amplified from *Nilaparvata lugens* cDNA which corresponded to a *Nilaparvata lugens* EST sequence in the public database Genbank with accession number CAH65679.2. To isolate cDNA sequences comprising a portion of the NL023 gene, a series of PCR reactions with EST based specific primers were performed using PerfectShot™ ExTaq (Cat N°. RR005A, Takara Bio Inc.) following the manufacturer's protocol.

For NL023, the specific primers oGBKW002 and oGBKW003 (represented herein as SEQ ID NO: 1157 and SEQ ID NO: 1158, respectively) were used in two independent PCR reactions with the following conditions: 3 minutes at 95° C., followed by 30 cycles of 30 seconds at 95° C., 30 seconds at 56° C. and 2 minutes at 72° C., followed by 10 minutes at 72° C. The resulting PCR products were analyzed on agarose gel, purified (QIAquick® Gel Extraction Kit; Cat. N°. 28706, Qiagen), cloned into the pCR4-TOPO vector (Cat N°. K4575-40, Invitrogen) and sequenced. The consensus sequence resulting from the sequencing of both PCR products is herein represented by SEQ ID NO: 1111 and is referred to as the partial sequence of the NL023 gene. The corresponding partial amino acid sequence is herein represented as SEQ ID NO: 1112.

C. dsRNA Production of *Nilaparvata lugens* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 4. The conditions in the PCR reactions were as follows: for NL001: 4 minutes at 94° C., followed by 35 cycles of 30 seconds at 94° C., 30 seconds at 60° C. and 1 minute at 72° C., followed by 10 minutes at 72° C.; for NL002: 4 minutes at 94° C., followed by 35 cycles of 30 seconds at 94° C., 30 seconds at 60° C. and 1 minute at 72° C., followed by 10 minutes at 72° C.; for NL003: 4 minutes at 94° C., followed by 35 cycles of 30 seconds at 94° C., 30 seconds at 66° C. and 1 minute at 72° C., followed by 10 minutes at 72° C.; for NL004: 4 minutes at 95° C., followed by 35 cycles of 30 seconds at 95° C., 30 seconds at 54° C. and 1 minute at 72° C., followed by 10 minutes at 72° C.; for NL005: 4 minutes at 95° C., followed by 35 cycles of 30 seconds at 95° C., 30 seconds at 57° C. and 1 minute at 72° C., followed by 10 minutes at 72° C.; for NL006: 4 minutes at 95° C., followed by 35 cycles of 30 seconds at 95° C., 30 seconds at 54° C. and 1 minute at 72° C., followed by 10 minutes at 72° C.; for NL007: 4 minutes at 95° C., followed by 35 cycles of 30 seconds at 95° C., 30 seconds at 51° C. and 1 minute at 72° C., followed by 10 minutes at 72° C.; for NL008: 4 minutes at 95° C., followed by 35 cycles of 30 seconds at 95° C., 30 seconds at 54° C. and 1 minute at 72° C., followed by 10 minutes at 72° C.; for NL009: 4 minutes at 95° C., followed by 35 cycles of 30 seconds at 95° C., 30 seconds at 54° C. and 1 minute at 72° C., followed by 10 minutes at 72° C.; for NL010: 4 minutes at 95° C., followed by 35 cycles of 30 seconds at 95° C., 30 seconds at 54° C. and 1 minute at 72° C., followed by 10 minutes at 72° C.; for NL011: 4 minutes at 95° C., followed by 35 cycles of 30 seconds at 95° C., 30 seconds at 53° C. and 1 minute at 72° C., followed by 10 minutes at 72° C.; for NL012: 4 minutes at 95° C., followed by 35 cycles of 30 seconds at 95° C., 30 seconds at 53° C. and 1 minute at 72° C., followed by 10 minutes at 72° C.; for NL013: 4 minutes at 95° C., followed by 35 cycles of 30 seconds at 95° C., 30 seconds at 55° C. and 1 minute at 72° C., followed by 10 minutes at 72° C.; for NL014: 4 minutes at 95° C., followed by 35 cycles of 30 seconds at 95° C., 30 seconds at 51° C. and 1 minute at 72° C., followed by 10 minutes at 72° C.; for NL015: 4 minutes at 95° C., followed by 35 cycles of 30 seconds at 95° C., 30 seconds at 55° C. and 1 minute at 72° C., followed by 10 minutes at 72° C.; for NL016: 4 minutes at 95° C., followed by 35 cycles of 30 seconds at 95° C., 30 seconds at 57° C. and 1 minute at 72° C., followed by 10 minutes at 72° C.; for NL018: 4 minutes at 95° C., followed by 35 cycles of 30 seconds at 95° C., 30 seconds at 55° C. and 1 minute at 72° C., followed by 10 minutes at 72° C.; for NL019: 4 minutes at 95° C., followed by 35 cycles of 30 seconds at 95° C., 30 seconds at 54° C. and 1 minute at 72° C., followed by 10 minutes at 72° C.; for NL021: 4 minutes at 95° C., followed by 35 cycles of 30 seconds at 95° C., 30 seconds at 55° C. and 1 minute at 72° C., followed by 10 minutes at 72° C.; for NL022: 4 minutes at 95° C., followed by 35 cycles of 30 seconds at 95° C., 30 seconds at 53° C. and 1 minute at 72° C., followed by 10 minutes at 72° C.; for NL023: 4 minutes at 95° C., followed by 35 cycles of 30 seconds at 95° C., 30 seconds at 52° C. and 1 minute at 72° C., followed by 10 minutes at 72° C.; and for NL027: 4 minutes at 95° C., followed by 35 cycles of 30 seconds at 95° C., 30 seconds at 52° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 4-NL. The resulting PCR products were analyzed on agarose gel and purified by PCR purification kit (Qiaquick PCR Purification Kit, Cat. Nr. 28106, Qiagen). The generated T7 forward and reverse templates were mixed to be transcribed and the resulting RNA strands were annealed, DNase and RNase treated, and purified by sodium acetate, following the manufacturer's instructions, but with the following modification: RNA peppet is washed twice in 70% ethanol. The sense strand of the resulting dsRNA for each of the target genes is given in Table 8-NL.

The template DNA used for the PCR reactions with T7 primers on the green fluorescent protein (gfp) control was the plasmid pPD96.12 (the Fire Lab, http://genome-www.stanford.edu/group/fire/), which contains the wild-type gfp coding sequence interspersed by 3 synthetic introns. Double-stranded RNA was synthesized using the commercially available kit T7 RiboMAX™ Express RNAi System (Cat. N°. P1700, Promega). First two separate single 5' T7 RNA polymerase promoter templates were generated in two separate PCR reactions, each reaction containing the target sequence in a different orientation relative to the T7 promoter. For gfp, the sense T7 template was generated using the specific T7 FW primer oGAU183 and the specific RV primer oGAU182 (represented herein as SEQ ID NO: 236 and SEQ ID NO: 237, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific FW primer oGAU181 and the specific T7 RV primer oGAU184 (represented herein as SEQ ID NO: 238 and SEQ ID NO: 239, respectively) in a PCR reaction with the same conditions as described above. The resulting PCR products were analyzed on agarose gel and purified (QIAquick® PCR Purification Kit; Cat. N°. 28106, Qiagen). The generated T7 FW and RV templates were mixed to be transcribed and the resulting RNA strands were annealed, DNase and RNase treated, and purified by precipitation with sodium acetate and isopropanol, following the manufacturer's protocol, but with the following modification: RNA peppet is washed twice in 70% ethanol. The sense strands of the resulting dsRNA is herein represented by SEQ ID NO: 235.

D. Laboratory Trials to Screen dsRNA Targets Using Liquid Artificial Diet for Activity Against *Nilaparvata lugens*

Liquid artificial diet (MMD-1) for the rice brown planthopper, *Nilaparvata lugens*, was prepared as described by Koyama (1988) [Artificial rearing and nutritional physiology of the planthoppers and leafhoppers (Homoptera: Delphacidae and Deltocephalidae) on a holidic diet. *JARQ* 22: 20-27], but with a modification in final concentration of diet component sucrose: 14.4% (weight over volume) was used. Diet components were prepared as separate concentrates: 10× mineral stock (stored at 4° C.), 2× amino acid stock (stored at −20° C.) and 10× vitamin stock (stored at −20° C.). The stock components were mixed immediately prior to the start of a bioassay to 4/3× concentration to allow dilution with the test dsRNA solution (4× concentration), pH adjusted to 6.5, and filter-sterilised into approximately 500 µA aliquots.

Rice brown planthopper (*Nilaparvata lugens*) was reared on two-to-three month old rice (*Oryza sativa* cv Taichung Native 1) plants in a controlled environment chamber: 27±2° C., 80% relative humidity, with a 16:8 hours light:dark photoperiod. A feeding chamber comprised 10 first or second instar nymphs placed in a small petri dish (with diameter 3 cm) covered with a single layer of thinly stretched parafilm M onto which 50 µA of diet was added. The chamber was sealed with a second layer of parafilm and incubated under the same conditions as the adult cultures but with no direct light exposure. Diet with dsRNA was refreshed every other day and the insects' survival assessed daily. Per treatment, 5 bioassay feeding chambers (replicates) were set up simultaneously. Test and control (gfp) dsRNA solutions were incorporated into the diet to a final concentration of 2 mg/ml. The feeding chambers were kept at 27±2° C., 80% relative humidity, with a 16:8 hours light:dark photoperiod. Insect survival data were analysed using the Kaplan-Meier survival curve model and the survival between groups were compared using the logrank test (Prism version 4.0).

Feeding liquid artificial diet supplemented with intact naked dsRNAs to *Nilaparvata lugens* in vitro using a feeding chamber resulted in significant increases in nymphal mortalities as shown in four separate bioassays (FIGS. 23A-23D; Tables 1a-d-NL). These results demonstrate that dsRNAs corresponding to different essential BPH genes showed significant toxicity towards the rice brown planthopper.

Effect of gfp dsRNA on BPH survival in these bioassays is not significantly different to survival on diet only Tables 10a-d-NL show a summary of the survival of *Nilaparvata lugens* on artificial diet supplemented with 2 mg/ml (final concentration) of the following targets; in Table 10(a)-NL: NL002, NL003, NL005, NL010; in Table 10(b)-NL NL009, NL016; in Table 10(c)-NL NL014, NL018; and in Table 10(d)-NL NL013, NL015, NL021. In the survival analysis column, the effect of RNAi is indicated as follows: +=significantly decreased survival compared to gfp dsRNA control (alpha<0.05); −=no significant difference in survival compared to gfp dsRNA control. Survival curves were compared (between diet only and diet supplemented with test dsRNA, gfp dsRNA and test dsRNA, and diet only and gfp dsRNA) using the logrank test.

E. Laboratory Trials to Screen dsRNAs at Different Concentrations Using Artificial Diet for Activity Against *Nilaparvata lugens*

Fifty µl of liquid artificial diet supplemented with different concentrations of target NL002 dsRNA, namely 1, 0.2, 0.08, and 0.04 mg/ml (final concentration), was applied to the brown planthopper feeding chambers. Diet with dsRNA was refreshed every other day and the insects' survival assessed daily. Per treatment, 5 bioassay feeding chambers (replicates) were set up simultaneously. The feeding chambers were kept at 27±2° C., 80% relative humidity, with a 16:8 hours light:dark photoperiod. Insect survival data were analysed using the Kaplan-Meier survival curve model and the survival between groups were compared using the logrank test (Prism version 4.0).

Figure 24:
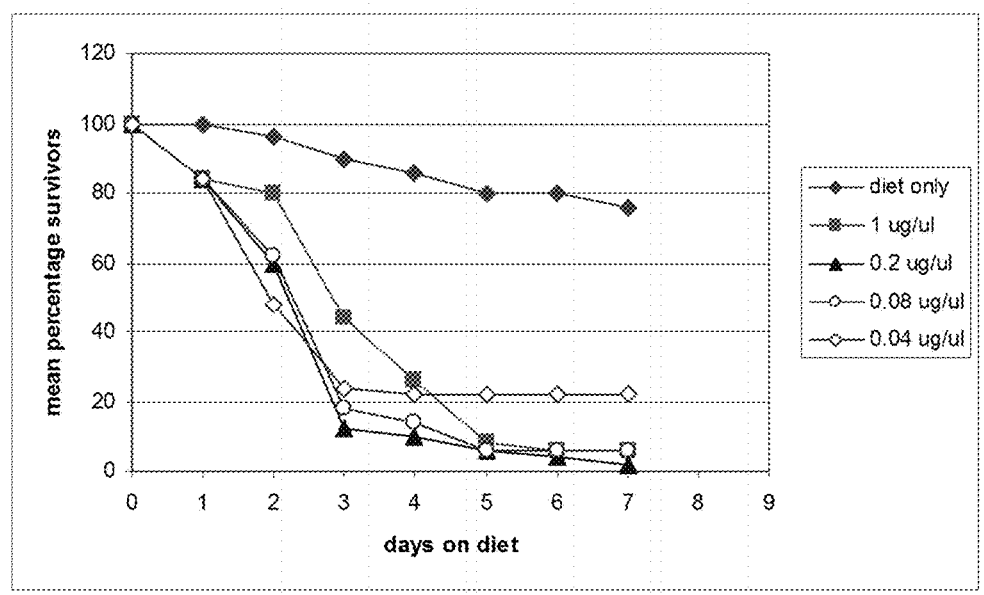

Feeding liquid artificial diet supplemented with intact naked dsRNAs of target NL002 at different concentrations resulted in significantly higher BPH mortalities at final concentrations of as low as 0.04 mg dsRNA per ml diet when compared with survival on diet only, as shown in FIG. 24 and Table 9-NL. Table 9-NL summarizes the survival of *Nilaparvata lugens* artificial diet feeding trial supplemented with 1, 0.2, 0.08, & 0.04 mg/ml (final concentration) of target NL002. In the survival analysis column the effect of RNAi is indicated as follows: +=significantly decreases survival compared to diet only control (alpha<0.05); −=no significant differences in survival compared to diet only control. Survival curves were compared using the logrank test.

F. Cloning of a BPH Gene Fragment in a Vector Suitable for Bacterial Production of Insect-Active Double-Stranded RNA What follows is an example of cloning a DNA fragment corresponding to a BPH gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-NL. The recombinant vector harbouring this sequence is named pGBNJ00.

G. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).
Transformation of AB309-105 and BL21(DE3)

Three hundred ng of the plasmid are added to and gently mixed in a 50 µl aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).
Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.
Heat Treatment of Bacteria Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

H. Laboratory Trials to Test *Escherichia coli* Expressing dsRNA Targets Against *Nilaparvata lugens*

Plant-Based Bioassays

Whole plants are sprayed with suspensions of chemically induced bacteria expressing dsRNA prior to feeding the plants to BPH. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. BPH are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 10: *Chilo suppressalis* (Rice Striped Stem Borer)

A. Cloning of Partial Sequence of the *Chilo suppressalis* Genes Via Family PCR

High quality, intact RNA was isolated from the 4 different larval stages of *Chilo suppressalis* (rice striped stem borer) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the CS001, CS002, CS003, CS006, CS007, CS009, CS011, CS013, CS014, CS015, CS016 and CS018 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-CS. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K2500-20, Invitrogen), and sequenced. The sequences of the resulting PCR products are represented by the respective SEQ ID NO:s as given in Table 2-CS and are referred to as the partial sequences. The corresponding partial amino acid sequences are represented by the respective SEQ ID NO:s as given in Table 3-CS.

B. dsRNA Production of the Chilo suppressalis Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-CS. The conditions in the PCR reactions were as follows: 4 minutes at 95° C., followed by 35 cycles of 30 seconds at 95° C., 30 seconds at 55° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-CS. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-CS.

C. Laboratory Trials to Test dsRNA Targets, Using Artificial Diet for Activity Against Chilo suppressalis Larvae Rice striped stem borers, Chilo suppressalis, (origin: Syngenta, Stein, Switzerland) were maintained on a modified artificial diet based on that described by Kamano and Sato, 1985 (in: Handbook of Insect Rearing. Volumes I & II. P Singh and RF Moore, eds., Elsevier Science Publishers, Amsterdam and New York, 1985, pp 448). Briefly, a liter diet was made up as follows: 20 g of agar added to 980 ml of Milli-Q water and autoclaved; the agar solution was cooled down to approximately 55° C. and the remaining ingredients were added and mixed thoroughly: 40 g corn flour (Polenta), 20 g cellulose, 30 g sucrose, 30 g casein, 20 g wheat germ (toasted), 8 g Wesson salt mixture, 12 g Vanderzant vitamin mix, 1.8 g sorbic acid, 1.6 g nipagin (methylparaben), 0.3 g aureomycin, 0.4 g cholesterol and 0.6 g L-cysteine. The diet was cooled down to approx. 45° C. and poured into rearing trays or cups. The diet was left to set in a horizontal laminair flow cabin. Rice leaf sections with oviposited eggs were removed from a cage housing adult moths and pinned to the solid diet in the rearing cup or tray. Eggs were left to hatch and neonate larvae were available for bioassays and the maintenance of the insect cultures. During the trials and rearings, the conditions were 28±2° C. and 80±5% relative humidity, with a 16:8 hour light:dark photoperiod.

The same artificial diet is used for the bioassays but in this case the diet is poured equally in 24 multiwell plates, with each well containing 1 ml diet. Once the diet is set, the test formulations are applied to the diet's surface (2 $cm^2$), at the rate of 50 µl of 1 µg/µl dsRNA of target. The dsRNA solutions are left to dry and two first instar moth larvae are placed in each well. After 7 days, the larvae are transferred to fresh treated diet in multiwell plates. At day 14 (i.e. 14 days post bioassay start) the number of live and dead insects is recorded and examined for abnormalities. Twenty-four larvae in total are tested per treatment.

An alternative bioassay is performed in which treated rice leaves are fed to neonate larvae of the rice striped stem borer. Small leaf sections of Indica rice variety Taichung native 1 are dipped in 0.05% Triton X-100 solution containing 1 µg/µl of target dsRNA, left to dry and each section placed in a well of a 24 multiwell plate containing gellified 2% agar. Two neonates are transferred from the rearing tray to each dsRNA treated leaf section (24 larvae per treatment). After 4 and 8 days, the larvae are transferred to fresh treated rice leaf sections. The number of live and dead larvae are assessed on days 4, 8 and 12; any abnormalities are also recorded.

D. Cloning of a SSB Gene Fragment in a Vector Suitable for Bacterial Production of Insect-Active Double-Stranded RNA What follows is an example of cloning a DNA fragment corresponding to an SSB gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-CS. The recombinant vector harbouring this sequence is named pGBNJ00XX.

E. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 µl aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 µg/ml cholesterol) supplemented with 100 µg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Chilo suppressalis*

Plant-Based Bioassays

Whole plants are sprayed with suspensions of chemically induced bacteria expressing dsRNA prior to feeding the plants to SSB. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. SSB are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 9: *Plutella xylostella* (Diamondback Moth)

A. Cloning of a Partial Sequence of the *Plutella xylostella*

High quality, intact RNA was isolated from all the different larval stages of *Plutella xylostella* (Diamondback moth; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the PX001, PX009, PX010, PX015, PX016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-PX. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. (for PX001, PX009, PX015, PX016); 10 minutes at 95° C., followed by 40 cycles of 30 seconds at 95° C., 1 minute at 54° C. and 2 minute and 30 seconds at 72° C., followed by 7 minutes at 72° C. (for PX010). The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen) and sequenced. The sequences of the resulting PCR products are represented by the respective SEQ ID NO:s as given in Table 2-PX and are referred to as the partial sequences. The corresponding partial amino acid sequence are represented by the respective SEQ ID NO:s as given in Table 3-PX.

B. dsRNA Production of the *Plutella xylostella* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-PX. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-PX. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-PX.

C. Laboratory Trials to Test dsRNA Targets, Using Artificial Diet for Activity Against *Plutella xylostella* Larvae Diamond-back moths, *Plutella xylostella*, were maintained at Insect Investigations Ltd. (origin: Newcastle University, Newcastle-upon-Tyne, UK). The insects were reared on cabbage leaves. First instar, mixed sex larvae (approximately 1 day old) were selected for use in the trial. Insects were maintained in Eppendorf tubes (1.5 ml capacity). Commercially available Diamond-back moth diet (Bio-Serv, NJ, USA), prepared following the manufacturer's instructions, was placed in the lid of each tube (0.25 ml capacity, 8 mm diameter). While still liquid, the diet was smoother over to remove excess and produce an even surface.

Once the diet has set the test formulations are applied to the diet's surface, at the rate of 25 µl undiluted formulation (1 µg/µl dsRNA of targets) per replicate. The test formulations are allowed to dry and one first instar moth larva is placed in each tube. The larva is placed on the surface of the diet in the lid and the tube carefully closed. The tubes are stored upside down, on their lids such that each larva remains on the surface of the diet. Twice weekly the larvae are transferred to new Eppendorf tubes with fresh diet. The insects are provided with treated diet for the first two weeks of the trial and thereafter with untreated diet.

Assessments are made twice weekly for a total of 38 days at which point all larvae are dead. At each assessment the insects are assessed as live or dead and examined for abnormalities. Forty single larva replicates are performed for each of the treatments. During the trial the test conditions are 23 to 26° C. and 50 to 65% relative humidity, with a 16:8 hour light:dark photoperiod.

D. Cloning of a DBM Gene Fragment in a Vector Suitable for Bacterial Production of Insect-Active Double-Stranded RNA What follows is an example of cloning a DNA fragment corresponding to a DBM gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8-PX. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-PX. The recombinant vector harbouring this sequence is named pGBNJ00XX.

E. Expression and Production of a Double-Stranded RNA Target in Two Strains of *Escherichia coli*: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 µA aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty µl of room temperature SOC medium is added to the cells and the suspension incubated on a shaker (250 rpm) at 37° C. for 1 hour. One hundred µl of the bacterial cell suspension is transferred to a 500 ml conical flask containing 150 ml of liquid Luria-Bertani (LB) broth supplemented with 100 µg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Plutella xylostella*

Plant-Based Bioassays

Whole plants are sprayed with suspensions of chemically induced bacteria expressing dsRNA prior to feeding the plants to DBM. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. DBM are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 12: *Acheta domesticus* (House Cricket)

A. Cloning *Acheta domesticus* Partial Sequences

High quality, intact RNA was isolated from all the different insect stages of *Acheta domesticus* (house cricket; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the AD001, AD002, AD009, AD015 and AD016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-AD. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen) and sequenced. The sequences of the resulting PCR products are represented by the respective SEQ ID NO:s as given in Table 2-AD and are referred to as the partial sequences. The corresponding partial amino acid sequence are represented by the respective SEQ ID NO:s as given in Table 3-AD.

B. dsRNA Production of the *Acheta domesticus* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-AD. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-AD. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-AD.

C. Laboratory Trials to Test dsRNA Targets, Using Artificial Diet for Activity Against Acheta domesticus Larvae House crickets, *Acheta domesticus*, were maintained at Insect Investigations Ltd. (origin: Blades Biological Ltd., Kent, UK). The insects were reared on bran pellets and cabbage leaves. Mixed sex nymphs of equal size and no more than 5 days old were selected for use in the trial. Double-stranded RNA is mixed with a wheat-based pelleted rodent diet (rat and mouse standard diet, B & K Universal Ltd., Grimston, Aldbrough, Hull, UK). The diet, BK001P, contains the following ingredients in descending order by weight: wheat, soya, wheatfeed, barley, pellet binder, rodent 5 vit min, fat blend, dicalcium phosphate, mould carb. The pelleted rodent diet is finely ground and heat-treated in a microwave oven prior to mixing, in order to inactivate any enzyme components. All rodent diet is taken from the same batch in order to ensure consistency. The ground diet and dsRNA are mixed thoroughly and formed into small pellets of equal weight, which are allowed to dry overnight at room temperature.

Double-stranded RNA samples from targets and gfp control at concentrations 10 μg/μl were applied in the ratio 1 g ground diet plus 1 ml dsRNA solution, thereby resulting in an application rate of 10 mg dsRNA per g pellet. Pellets are replaced weekly. The insects are provided with treated pellets for the first three weeks of the trial. Thereafter untreated pellets are provided. Insects are maintained within lidded plastic containers (9 cm diameter, 4.5 cm deep), ten per container. Each arena contains one treated bait pellet and one water source (damp cotton wool ball), each placed in a separate small weigh boat. The water is replenished ad lib throughout the experiment.

Assessments are made at twice weekly intervals, with no more than four days between assessments, until all the control insects had either died or moulted to the adult stage (84 days). At each assessment the insects are assessed as live or dead, and examined for abnormalities. From day 46 onwards, once moulting to adult has commenced, all insects (live and dead) are assessed as nymph or adult. Surviving insects are weighed on day 55 of the trial. Four replicates are performed for each of the treatments. During the trial the test conditions are 25 to 33° C. and 20 to 25% relative humidity, with a 12:12 hour light:dark photoperiod.

D. Cloning of a HC Gene Fragment in a Vector Suitable for Bacterial Production of Insect-Active Double-Stranded RNA What follows is an example of cloning a DNA fragment corresponding to a HC gene target in a vector for the expression of double-stranded RNA in a bacterial host, although any vector comprising a T7 promoter or any other promoter for efficient transcription in bacteria, may be used (reference to WO0001846).

The sequences of the specific primers used for the amplification of target genes are provided in Table 8. The template used is the pCR8/GW/topo vector containing any of target sequences. The primers are used in a PCR reaction with the following conditions: 5 minutes at 98° C., followed by 30 cycles of 10 seconds at 98° C., 30 seconds at 55° C. and 2 minutes at 72° C., followed by 10 minutes at 72° C. The resulting PCR fragment is analyzed on agarose gel, purified (QIAquick Gel Extraction kit, Cat. Nr. 28706, Qiagen), blunt-end cloned into Srf I-linearized pGNA49A vector (reference to WO00188121A1), and sequenced. The sequence of the resulting PCR product corresponds to the respective sequence as given in Table 8-AD. The recombinant vector harbouring this sequence is named pGBNJ00XX.

E. Expression and Production of a Double-Stranded RNA Target in Two Strains of Escherichia coli: (1) AB309-105, and, (2) BL21(DE3)

The procedures described below are followed in order to express suitable levels of insect-active double-stranded RNA of insect target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 μA aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath.

After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

F. Laboratory Trials to Test *Escherichia coli* Expressing dsRNA Targets Against *Acheta domesticus*

Plant-Based Bioassays

Whole plants are sprayed with suspensions of chemically induced bacteria expressing dsRNA prior to feeding the plants to HC. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. HC are placed on each treated plant in the cage. Plants are treated with a suspension of *E. coli* AB309-105 harbouring the pGBNJ001 plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB309-105 expressing target dsRNA from pGBNJ003 lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 13: *Pyricularia grisea* (Rice Blast)

A. Cloning *P. grisea* Partial Sequences

High quality, intact RNA is isolated from different growth stages of *P. grisea* using TRIzol Reagent (Cat. Nr. 15596-026/15596-018, Invitrogen, Rockville, Md., USA) following the manufacturer's instructions. Genomic DNA present in the RNA preparation is removed by DNase treatment following the manufacturer's instructions (Cat. Nr. 1700, Promega). cDNA is generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of a target gene, PCR is performed with degenerate primers using Amplitaq Gold (Cat. Nr. N8080240, Applied Biosystems) following the manufacturer's instructions. The resultant PCR products are fractionated and sequenced.

B. dsRNA Production of *P. grisea* Genes dsRNA is synthesized in milligram amounts using a commercially available kit, such as T7 Ribomax™ Express RNAi System (Cat. Nr. P1700, Promega), following the manufacturer's instructions. The resulting PCR products are analyzed on an agarose gel and purified by a PCR purification kit (e.g. Qiaquick PCR Purification Kit, Cat. Nr. 28106, Qiagen) and $NaClO_4$ precipitation. The producer T7 forward and reverse templates are mixed and the resulting RNA strands are annealed, then DNase and RNase treated, and purified by sodium acetate, following the manufacturer's instructions.

C. Expression and Production of a Double-Stranded RNA Target in Two Strains of *Escherichia coli*: (1) AB309-105, and, (2) BL21(DE3)

The procedures described below are followed in order to express suitable levels of fungal double-stranded RNA of fungal target in bacteria. An RNaseIII-deficient strain, AB309-105, is used in comparison to wild-type RNaseIII-containing bacteria, BL21(DE3).

Transformation of AB309-105 and BL21(DE3)

Three hundred ng of the plasmid are added to and gently mixed in a 50 μl aliquot of ice-chilled chemically competent *E. coli* strain AB309-105 or BL21(DE3). The cells are incubated on ice for 20 minutes before subjecting them to a heat shock treatment of 37° C. for 5 minutes, after which the cells are placed back on ice for a further 5 minutes. Four hundred and fifty μl of room temperature SOC medium is added to the cells and the suspension incubated on a shaker (250 rpm) at 37° C. for 1 hour. One hundred μl of the bacterial cell suspension is transferred to a 500 ml conical flask containing 150 ml of liquid Luria-Bertani (LB) broth supplemented with 100 μg/ml carbenicillin antibiotic. The culture is incubated on an Innova 4430 shaker (250 rpm) at 37° C. overnight (16 to 18 hours).

Chemical Induction of Double-Stranded RNA Expression in AB309-105 and BL21(DE3)

Expression of double-stranded RNA from the recombinant vector, pGBNJ003, in the bacterial strain AB309-105 or BL21(DE3) is made possible since all the genetic components for controlled expression are present. In the presence of the chemical inducer isopropylthiogalactoside, or IPTG, the T7 polymerase will drive the transcription of the target sequence in both antisense and sense directions since these are flanked by oppositely oriented T7 promoters.

The optical density at 600 nm of the overnight bacterial culture is measured using an appropriate spectrophotometer and adjusted to a value of 1 by the addition of fresh LB broth. Fifty ml of this culture is transferred to a 50 ml Falcon tube and the culture then centrifuged at 3000 g at 15° C. for 10 minutes. The supernatant is removed and the bacterial pellet resuspended in 50 ml of fresh S complete medium (SNC medium plus 5 μg/ml cholesterol) supplemented with 100 μg/ml carbenicillin and 1 mM IPTG. The bacteria are induced for 2 to 4 hours at room temperature.

Heat Treatment of Bacteria

Bacteria are killed by heat treatment in order to minimise the risk of contamination of the artificial diet in the test plates. However, heat treatment of bacteria expressing double-stranded RNA is not a prerequisite for inducing toxicity towards the insects due to RNA interference. The induced bacterial culture is centrifuged at 3000 g at room temperature for 10 minutes, the supernatant discarded and the pellet subjected to 80° C. for 20 minutes in a water bath. After heat treatment, the bacterial pellet is resuspended in 1.5 ml MilliQ water and the suspension transferred to a microfuge tube. Several tubes are prepared and used in the bioassays for each refreshment. The tubes are stored at −20° C. until further use.

SEQUENCE LISTING (2485 sequences)

SEQ ID NO: 1 - DNA, 437 bp, Leptinotarsa decemlineata
ggccccaagaagcatttgaagcgtttgaatgccccaaaagcatggatgttggataaattgggaggtgttttcgcacctcgcccatctacaggacctcacaaattgcgagagtctttgcccttggtgatcttcctacgtaaccgattgaagtatgctttgactaacagcgaagttactaagattgttatgcaaaggttaatcaaagtagatggaaaagtgaggaccgactccaattaccctgctgggtttatggatgttattaccattgaaaaaactggtgaatttttccgactcatctatgatgttaaaggacgatttgcagtgcatcgtattactgctgaggaagcaaagtacaaactatgcaaagtcaggaggatgcaaactggccccaaaggaattcccttcatagtgacacacgacggccgcaccatccgcta

SEQ ID NO: 2 - protein, 145 aa, Leptinotarsa decemlineata
GPKKHLKRLNAPKAWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAVHRITAEEAKYKLCKVRRMQTGPKGIPFIVTHDGRTIR

SEQ ID NO: 3 - DNA, 220 bp, Leptinotarsa decemlineata
gcaatgtcatccatcatgtcgtgtacattgtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgcttcttccgcttcagcgcttgcatggccgctc

SEQ ID NO: 4 - protein, 71 aa, Leptinotarsa decemlineata
AMQALKRKKRLEKNQLQIDGTLTTIELQREALEGASTNTTVLESMKNAAEALKKAHKNLDVDNVHDMMDDI

SEQ ID NO: 5 - DNA, 490 bp, Leptinotarsa decemlineata
caggttcttcctcttgacgcgtccagggcgaccaccaccgaatggagatttgagcgagaagtcaatatgcttctgggaatcaagtctcacaatgaagcttggaatattcacgacctgcttacgaaccctgatatgtctttgacggaccagcacacgagcatgatggattgattttgcaagccccaacttgaaaacttgtgtttggagacgtcgttccaagaaatcttcaatcttcaaacccaagacgtaatcaagcttcatacgggtttcatccaacactccaatacgcaccaaccgacgaagaagagcattgccttcaaacaacctgcgctgatctttctcttccaaagtcagaagttctctggcagctttacggatttttgccaaggtatacttgactcgccacacttcacgtttgttcctaagaccatattctcctatgattttcaactcctgatcaagacgtgccttttcataaggtcgcctggga

SEQ ID NO: 6 - protein, 163 aa, Leptinotarsa decemlineata
PRRPYEKARLDQELKIIGEYGLRNKREVWRVKYTLAKIRKAARELLTLEEKDQRRLFEGNALLRRLVRIGVLDETRMKLDYVLGLKIEDFLERRLQTQVFKLGLAKSIHHARVLVRQRHIRVRKQVVNIPSFIVRLDSQKHIDFSLKSPFGGGRPGRVKRKNL

SEQ ID NO: 7 - DNA, 561 bp, Leptinotarsa decemlineata
ggagcgagactacacaactatggctggcaggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagcgaattggcgatcaagaagagcagttcgag

SEQ ID NO: 8 - protein, 183 aa, Leptinotarsa decemlineata
HNYGWQVLVASGVVEYIDTLEEETVMIAMNPEDLRQDKEYAYCTTYTHCEIHPAMILGVCASIIPFPDHNQSPRNTYQSAMGKQAMGVYITNFHVRMDTLAHVLYYPHKPLVTTRSMEYLRFRELPAGINSIVAIACYTGYNQEDSVILNASAVERGFFRSVFYRSYKDAESKRIGDQEEQFE

SEQ ID NO: 9 - DNA, 1031 bp, Leptinotarsa decemlineata
ccgaagaaggatgtgaagggtacttacgtatccatacacagttcaggcttcagagattttttattgaaaccagaaattctaagagctatagttgactgcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagggtcaacattgtcttcaactatgatatgccagaggactccgacacctacttgcatcg

SEQ ID NO: 10 - protein, 343 aa, Leptinotarsa decemlineata
PKKDVKGTYVSIHSSGFRDFLLKPEILRAIVDCGFEHPSEVQHECIPQAVIGMDILCQAKSGMGKTAVFVLATLQQLEPADNVVYVLVMCHTRELAFQISKEYERFSKYMPSVKVGVFFGGMPIANDEEVLKNKCPHIVVGTPGRILALVKSRKLVLKNLKHFILDECDKMLELLDMRRDVQEIYRNTPHTKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQKRILVATNLFGRGMDIERVNIVFNYDMPEDSDTYLH

SEQ ID NO: 11 - DNA, 1601 bp, Leptinotarsa decemlineata
ctctcaaggattcgttgcagatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgaaaccatcgcccaatggcg

SEQ ID NO: 12 - protein, 260 aa, Leptinotarsa decemlineata
VKCSRELKIQGGIGSCVSLNVKNPLVSDTEIGMGNTVQWKMCTVTPSTTMALFFEVVNQHSAPIPQGGRGCIQFITQYQHASGQKRIRVTTVARNWADASANIHHVSAGFDQEAAAVIMARMAVYRAESDDSPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 13 - DNA, 529 bp, Leptinotarsa decemlineata
gtggaagcagggctggcatggcgacaaattctagattgggatcaccaataagcttcctagctagccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttccagtacctccatctccgaccaacacacacttgaaagtggg

SEQ ID NO: 14 - protein, 176 aa, Leptinotarsa decemlineata
PTFKCVLVGDGGTGKTTFVKRHMTGEFEKRYVATLGVEVHPLVFHTNRGPIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALLP

SEQ ID NO: 15 - DNA, 607 bp, Leptinotarsa decemlineata
cgcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcaacttctgcccgagatccg

SEQ ID NO: 16 - protein, 201 aa, Leptinotarsa decemlineata
QIKHMMAFIEQEANEKAEEIDAKAEEEFNIEKGRLVQQQRLKIMEYYEKKEKQVELQKKIQSSNMLNQARLKVLKVREDHVRTVLEEARKRLGQVTNDQGKYSQILESLILQGLYQLFEKDVTIRVRPQDRELVKSIIPTVTNKYKDATGKDIHLKIDDEIHLSQETTGGIDLLAQKNKIKISNTMEARLELISQQLLPEI

SEQ ID NO: 17 - DNA, 257 bp, Leptinotarsa decemlineata
gcaatggcatcaagttcatcgatgaagatgatcgccggagagtttttgtcagcttcttcaaaagctttgcgcaagttactctcagactcgccagcgagtttgctcatgatctccggcccgtttatcaagaagaagaacgccccagtctcattagccacggcgcgagcaatcagggtcttacccgtaccagggggaccatacagcagtatacccctagggggcttcacgccgatagccttgaagagcgatggatggcg

SEQ ID NO: 18 - protein, 85 aa, Leptinotarsa decemlineata
RHPSLFKAIGVKPPRGILLYGPPGTGKTLIARAVANETGAFFFLINGPEIMSKLAGESESNLRKAFEEADKNSPAIIFIDELDAI

SEQ ID NO: 19 - DNA, 957 bp, Leptinotarsa decemlineata
ggaataggatgggtaatgtcgtcgttgggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattaccagaggaccgttcacaccagacacagtc

SEQ ID NO: 20 - protein, 318 aa, Leptinotarsa decemlineata
TVSGVNGPLVILEDVKFPKYNEIVQLKLADGTIRSGQVLEVSGSKAVVQVFEGTSGIDAKNTACEFTGDILRTPVSEDMLGRVFNGSGKPIDKGPPILAEDFLDIQGQPINPWSRIYPEEMIQTGITAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 21 - DNA, 789 bp, Leptinotarsa decemlineata
cacctggttcaaggatgggcagcggataacggagtcgcagaaatacgagagcaccttctcgaacaaccaagcctccttgagggtaaaacaagcccagtctgaggactcgggacactacactttgttggcggagaaccctcaaggctgcatagtgtcatctgcttacttagccatagaaccggtaaccacccaggaagggttgatccacgagtccaccttcaagcagcaacagaccgaaatggagcaaatcgacaccagcaagaccttggcgcctaacttcgtcagggtttgcggggatagagacgtgaccgagggcaagatgacccgcttcgactgtcgcgtcactggtcgtccttatccagacgtgacatggtacataaacggtcgacaagtcaccgacgaccacaaccacaagattttggttaacgaatccggaaaccatgccctgatgatcaccaccgtgagcaggaacgactcaggagtagtgacctgcgtcgccaggaacaagacgggagaaacctccttccagtgcaaccttaacgtcatcgaaaaggaacaggtagtcgcgcccaagttcgtggagagatttaccacagtcaacgtggcagaaggagaaccagtgtctctgcgcgctagagctgttggcacgccggtgccgcgaatcacttggcagagggacggggcgcccctagccagcgggcccgacgttcgcatcgcgattgacggtggagcctctactttgaatatctcgagggccaaggcctcggatgctgcatggtaccgatgcac

SEQ ID NO: 22 - protein, 262 aa, Leptinotarsa decemlineata
TWFKDGQRITESQKYESTFSNNQASLRVKQAQSEDSGHYTLLAENPQGCIVSSAYLAIEPVTTQEGLIHESTFKQQQTEMEQIDTSKTLAPNFVRVCGDRDVTEGKMTRFDCRVTGRPYPDVTWYINGRQVTDDHNHKILVNESGNHALMITTVSRNDSGVVTCVARNKTGETSFQCNLNVIEKEQVVAPKFVERFTTVNVAEGEPVSLRARAVGTPVPRITWQRDGAPLASGPDVRIAIDGGASTLNISRAKASDAAWYRC

SEQ ID NO: 23 - DNA, 1033 bp, Leptinotarsa decemlineata
ccatggtggcgataaaccatacttgatatcgggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccgaacaggtctttgggtcggagactgtttcatctatacc

SEQ ID NO: 24 - protein, 344 aa, Leptinotarsa decemlineata
HGGDKPYLISGADDRLVKIWDYQNKTCVQTLEGHAQNVTAVCFHPELPVALTGSEDGTVRVWHTNTHRLENCLNYGFERVWTICCLKGSNNVSLGYDEGSILVKVGREEPAVSMDASGGKIIWARHSELQQANLKALPEGGEIRDGERLPVSVKDMGACEIYPQTIQHNPNGRFVVVCGDGEYIIYTAMALRNKAFGSAQEFVWAQDSSEYAIRESGSTIRIFKNFKERKNFKSDFSAEGIYGGFLLGIKSVSGLTFYDWETLDLVRRIEIQPRAVYWSDSGKLVCLATEDSYFILSYDSEQVQKARENNQVAEDGVEAAFDVLGEMNESVRTGLWVGDCFIYT

SEQ ID NO: 25 - DNA, 23 bp, artificial sequence
  Description of artificial sequence:  synthetic primer
ggccccaagaagcatttgaagcg

SEQ ID NO: 26 - DNA, 23 bp, artificial sequence
  Description of artificial sequence:  synthetic primer
tagcggatggtgcgdccrtcrtg

SEQ ID NO: 27 - DNA, 29 bp, artificial sequence
  Description of artificial sequence:  synthetic primer
gagcggccatgcaagcvctbaarmrraag

SEQ ID NO: 28 - DNA, 26 bp, artificial sequence
  Description of artificial sequence:  synthetic primer
gcaatgtcatccatcakrtcrtgcac

SEQ ID NO: 29 - DNA, 26 bp, artificial sequence
  Description of artificial sequence:  synthetic primer
  misc_feature (18)..(18): n is a, c, g, or t
tcggtcttctcgaagacntaygtkac

SEQ ID NO: 30 - DNA, 24 bp, artificial sequence
  Description of artificial sequence:  synthetic primer
caggttcttcctcttkacrcgdcc

SEQ ID NO: 31 - DNA, 29 bp, artificial sequence
  Description of artificial sequence:  synthetic primer
ggagcgagactacaacaaykayrgytggc

SEQ ID NO: 32 - DNA, 24 bp, artificial sequence
  Description of artificial sequence:  synthetic primer
ctcgaactgctcytcytgatcrcc

SEQ ID NO: 33 - DNA, 23 bp, artificial sequence
  Description of artificial sequence:  synthetic primer
ccgaagaaggaygtsaagggyac

SEQ ID NO: 34 - DNA, 26 bp, artificial sequence
  Description of artificial sequence:  synthetic primer
cgatgcaagtaggtgtckgartcytc

SEQ ID NO: 35 - DNA, 25 bp, artificial sequence
  Description of artificial sequence:  synthetic primer
ctctcaaggattckytrcaratgtc

SEQ ID NO: 36 - DNA, 23 bp, artificial sequence
  Description of artificial sequence:  synthetic primer
cgccattgggcratggtytckcc

SEQ ID NO: 37 - DNA, 26 bp, artificial sequence
  Description of artificial sequence:  synthetic primer
cccactttcaagtgygtrytrgtcgg

SEQ ID NO: 38 - DNA, 25 bp, artificial sequence
  Description of artificial sequence:  synthetic primer
gtggaagcagggcwggcatkgcrac

SEQ ID NO: 39 - DNA, 22 bp, artificial sequence
  Description of artificial sequence:  synthetic primer
cgcagatcaarcayatgatggc

SEQ ID NO: 40 - DNA, 21 bp, artificial sequence
  Description of artificial sequence:  synthetic primer
cggatctcgggcasmarytgc

SEQ ID NO: 41 - DNA, 23 bp, artificial sequence
  Description of artificial sequence:  synthetic primer
cgccatccrtcgctsttcaaggc

SEQ ID NO: 42 - DNA, 24 bp, artificial sequence
  Description of artificial sequence:  synthetic primer
gcaatggcatcaakytcrtcratg

SEQ ID NO: 43 - DNA, 24 bp, artificial sequence
  Description of artificial sequence:  synthetic primer
gactgtgtctggtgtraacggwcc

SEQ ID NO: 44 - DNA, 24 bp, artificial sequence
  Description of artificial sequence:  synthetic primer
ggaataggatgggtratrtcgtcg

SEQ ID NO: 45 - DNA, 24 bp, artificial sequence
  Description of artificial sequence:  synthetic primer
cacctggttcaagratggvcarmg

SEQ ID NO: 46 - DNA, 23 bp, artificial sequence
  Description of artificial sequence:  synthetic primer
gtgcatcggtaccahschgcrtc

SEQ ID NO: 47 - DNA, 22 bp, artificial sequence
  Description of artificial sequence:  synthetic primer
ccatggtggcgayaarccvtac

SEQ ID NO: 48 - DNA, 27 bp, artificial sequence
  Description of artificial sequence:  synthetic primer
ggtatagatgaarcartcdccvaccca

SEQ ID NO: 49 - DNA, 26 bp, Leptinotarsa decemlineata
ggccccaagaagcatttgaagcgttt

SEQ ID NO: 50 - DNA, 41 bp, Leptinotarsa decemlineata
aatgccccaaaagcatggatgttggataaattgggaggtgt

SEQ ID NO: 51 - DNA, 23 bp, Leptinotarsa decemlineata
gaagttactaagattgttatgca

SEQ ID NO: 52 - DNA, 26 bp, Leptinotarsa decemlineata
attgaaaaaactggtgaatttttccg

SEQ ID NO: 53 - DNA, 25 bp, Leptinotarsa decemlineata
acacacgacggccgcaccatccgct

SEQ ID NO: 54 - DNA, 26 bp, Leptinotarsa decemlineata
acacacgacggccgcaccatccgcta

SEQ ID NO: 55 - DNA, 24 bp, Leptinotarsa decemlineata
cccaagaagcatttgaagcgtttg

SEQ ID NO: 56 - DNA, 23 bp, Leptinotarsa decemlineata
gcaatgtcatccatcatgtcgtg

SEQ ID NO: 57 - DNA, 27 bp, Leptinotarsa decemlineata
caggttcttcctcttgacgcgtccagg

SEQ ID NO: 58 - DNA, 25 bp, Leptinotarsa decemlineata
ttgagcgagaagtcaatatgcttct

SEQ ID NO: 59 - DNA, 30 bp, Leptinotarsa decemlineata
ttccaagaaatcttcaatcttcaaacccaa

SEQ ID NO: 60 - DNA, 21 bp, Leptinotarsa decemlineata
ttcatccaacactccaatacg

SEQ ID NO: 61 - DNA, 24 bp, Leptinotarsa decemlineata
aagagcattgccttcaaacaacct

SEQ ID NO: 62 - DNA, 26 bp, Leptinotarsa decemlineata
agttctctggcagctttacggatttt

SEQ ID NO: 63 - DNA, 21 bp, Leptinotarsa decemlineata
ccacacttcacgtttgttcct

SEQ ID NO: 64 - DNA, 21 bp, Leptinotarsa decemlineata
ccgtatgaagcttgattacgt

SEQ ID NO: 65 - DNA, 23 bp, Leptinotarsa decemlineata
aggaacaaacgtgaagtgtggcg

SEQ ID NO: 66 - DNA, 26 bp, Leptinotarsa decemlineata
agcgctatgggtaagcaagctatggg

SEQ ID NO: 67 - DNA, 27 bp, Leptinotarsa decemlineata
tgttatactggttataatcaagaagat

SEQ ID NO: 68 - DNA, 23 bp, Leptinotarsa decemlineata
gaagttcagcacgaatgtattcc

SEQ ID NO: 69 - DNA, 27 bp, Leptinotarsa decemlineata
caagcaagtgatgatgttcagtgccac

SEQ ID NO: 70 - DNA, 23 bp, Leptinotarsa decemlineata
tgcaagaaattcatgcaagatcc

SEQ ID NO: 71 - DNA, 21 bp, Leptinotarsa decemlineata
aaatgaaaagaataaaaaatt

SEQ ID NO: 72 - DNA, 23 bp, Leptinotarsa decemlineata
cagaatttcccagccataggaat

SEQ ID NO: 73 - DNA, 23 bp, Leptinotarsa decemlineata
agcagttcaaagatttccagaag

SEQ ID NO: 74 - DNA, 24 bp, Leptinotarsa decemlineata
ttccaaatcagcaaagagtacgag

SEQ ID NO: 75 - DNA, 21 bp, Leptinotarsa decemlineata
tacccgcagttcatgtaccat

SEQ ID NO: 76 - DNA, 23 bp, Leptinotarsa decemlineata
cagtcgctgatcatgatccagcc

SEQ ID NO: 77 - DNA, 23 bp, Leptinotarsa decemlineata
ctcatggacacgttcttccagat

SEQ ID NO: 78 - DNA, 22 bp, Leptinotarsa decemlineata
ggggctgcatacagttcatcac

SEQ ID NO: 79 - DNA, 22 bp, Leptinotarsa decemlineata
cccgcagttcatgtaccatttg

SEQ ID NO: 80 - DNA, 23 bp, Leptinotarsa decemlineata
gacaatgccaaatacatgaagaa

SEQ ID NO: 81 - DNA, 24 bp, Leptinotarsa decemlineata
ttcgatcaggaggcagccgcagtg

SEQ ID NO: 82 - DNA, 23 bp, Leptinotarsa decemlineata
agcagggctggcatggcgacaaa

SEQ ID NO: 83 - DNA, 26 bp, Leptinotarsa decemlineata
ttctcaaagttgtagttagatttggc

SEQ ID NO: 84 - DNA, 23 bp, Leptinotarsa decemlineata
tactgcaaattcttcttcctatg

SEQ ID NO: 85 - DNA, 22 bp, Leptinotarsa decemlineata
ggtacattcttgtatgtaactc

SEQ ID NO: 86 - DNA, 23 bp, Leptinotarsa decemlineata
tcaaacatgataatagcacactg

SEQ ID NO: 87 - DNA, 24 bp, Leptinotarsa decemlineata
tctcctgaccggcagtgtcccata

SEQ ID NO: 88 - DNA, 26 bp, Leptinotarsa decemlineata
gctactttgggagttgaagtccatcc

SEQ ID NO: 89 - DNA, 27 bp, Leptinotarsa decemlineata
taactacaactttgagaagcctttcct

SEQ ID NO: 90 - DNA, 23 bp, Leptinotarsa decemlineata
aagtttggtggtctccgtgatgg

SEQ ID NO: 91 - DNA, 21 bp, Leptinotarsa decemlineata
gcagatcaagcatatgatggc

SEQ ID NO: 92 - DNA, 26 bp, Leptinotarsa decemlineata
atcaagcatatgatggctttcattga

SEQ ID NO: 93 - DNA, 23 bp, Leptinotarsa decemlineata
aatattgaaaaggggcgccttgt

SEQ ID NO: 94 - DNA, 23 bp, Leptinotarsa decemlineata
caacgtctcaagattatggaata

SEQ ID NO: 95 - DNA, 26 bp, Leptinotarsa decemlineata
attatggaatattatgagaagaaaga

SEQ ID NO: 96 - DNA, 24 bp, Leptinotarsa decemlineata
aacaaaatcaagatcagcaatact

SEQ ID NO: 97 - DNA, 22 bp, Leptinotarsa decemlineata
atgtcgtcgttgggcatagtca

SEQ ID NO: 98 - DNA, 41 bp, Leptinotarsa decemlineata
gtagctaaatcggtgtacatgtaacctgggaaaccacgacg

SEQ ID NO: 99 - DNA, 23 bp, Leptinotarsa decemlineata
gcagatacctcacgcaaagcttc

SEQ ID NO: 100 - DNA, 29 bp, Leptinotarsa decemlineata
ggatcgttggccaaattcaagaacaggca

SEQ ID NO: 101 - DNA, 32 bp, Leptinotarsa decemlineata
ttctccatagaaccgttctcttcgaaatcctg

SEQ ID NO: 102 - DNA, 23 bp, Leptinotarsa decemlineata
gctgtttccatgttaacacccat

SEQ ID NO: 103 - DNA, 25 bp, Leptinotarsa decemlineata
tccatgttaacacccatagcagcga

SEQ ID NO: 104 - DNA, 29 bp, Leptinotarsa decemlineata
ctacagatctgggcagcaatttcattgtg

SEQ ID NO: 105 - DNA, 23 bp, Leptinotarsa decemlineata
ggcagaccagctgcagagaaaat

SEQ ID NO: 106 - DNA, 47 bp, Leptinotarsa decemlineata
gagaaaatggggatcttctgaccacgagcaatggagttcatcacgtc

SEQ ID NO: 107 - DNA, 23 bp, Leptinotarsa decemlineata
atggagttcatcacgtcaatagc

SEQ ID NO: 108 - DNA, 98 bp, Leptinotarsa decemlineata
gtctggatcatttcctcaggatagatacgggaccacggattgattggttgaccctggatgtccaagaagtcttcagccaaaattgggggacctttgtc

SEQ ID NO: 109 - DNA, 23 bp, Leptinotarsa decemlineata
attgggggacctttgtcgatggg

SEQ ID NO: 110 - DNA, 140 bp, Leptinotarsa decemlineata
atgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttt

SEQ ID NO: 111 - DNA, 26 bp, Leptinotarsa decemlineata
acagcttttgacccactgacttccag

SEQ ID NO: 112 - DNA, 57 bp, Leptinotarsa decemlineata
gacccactgacttccagaacttgtcccgaacgtatagtgccatcagccagtttgagt

SEQ ID NO: 113 - DNA, 23 bp, Leptinotarsa decemlineata
ggaccgttcacaccagacacagt

SEQ ID NO: 114 - DNA, 27 bp, Leptinotarsa decemlineata
gactgtgtctggtgtgaacggtcctct

SEQ ID NO: 115 - DNA, 23 bp, Leptinotarsa decemlineata
ttctcttcgaaatcctgtttgaa

SEQ ID NO: 116 - DNA, 24 bp, Leptinotarsa decemlineata
gactgtgtvtggtgtgaacggtcc

SEQ ID NO: 117 - DNA, 38 bp, Leptinotarsa decemlineata
ggtcgtcgtggtttcccaggttacatgtacaccgattt

SEQ ID NO: 118 - DNA, 22 bp, Leptinotarsa decemlineata
tgacagctgccgaattcttggc

SEQ ID NO: 119 - DNA, 26 bp, Leptinotarsa decemlineata
caagtcaccgacgaccacaaccacaa

SEQ ID NO: 120 - DNA, 21 bp, Leptinotarsa decemlineata
atcgcgattgacggtggagcc

SEQ ID NO: 121 - DNA, 22 bp, Leptinotarsa decemlineata
agacgatcggttggttaaaatc

SEQ ID NO: 122 - DNA, 23 bp, Leptinotarsa decemlineata
gatatgggagcatgtgaaatata

SEQ ID NO: 123 - DNA, 21 bp, Leptinotarsa decemlineata
ttagagaattgtttgaattat

SEQ ID NO: 124 - DNA, 21 bp, Leptinotarsa decemlineata
aagaagcatttgaagcgtttg

SEQ ID NO: 125 - DNA, 21 bp, Leptinotarsa decemlineata
gttcttcctcttgacgcgtcc

SEQ ID NO: 126 - DNA, 23 bp, Leptinotarsa decemlineata
gcagctttacggatttttgccaa

SEQ ID NO: 127 - DNA, 22 bp, Leptinotarsa decemlineata
tttcaactcctgatcaagacgt

SEQ ID NO: 128 - DNA, 23 bp, Leptinotarsa decemlineata
gctatgggtaagcaagctatggg

SEQ ID NO: 129 - DNA, 21 bp, Leptinotarsa decemlineata
aaagaataaaaaattatttga

SEQ ID NO: 130 - DNA, 23 bp, Leptinotarsa decemlineata
aagcaagtgatgatgttcagtgc

SEQ ID NO: 131 - DNA, 23 bp, Leptinotarsa decemlineata
atgatggctttcattgaacaaga

SEQ ID NO: 132 - DNA, 23 bp, Leptinotarsa decemlineata
aacgccccagtctcattagccac

SEQ ID NO: 133 - DNA, 21 bp, Leptinotarsa decemlineata
ttttggcgtcgattcctgatg

SEQ ID NO: 134 - DNA, 23 bp, Leptinotarsa decemlineata
gtgtacatgtaacctgggaaacc

SEQ ID NO: 135 - DNA, 29 bp, Leptinotarsa decemlineata
gtgtacatgtaacctgggaaaccacgacg

SEQ ID NO: 136 - DNA, 23 bp, Leptinotarsa decemlineata
tagcggatggtgcggccgtcgtg

SEQ ID NO: 137 - DNA, 25 bp, Leptinotarsa decemlineata
ttccaagaaatcttcaatcttcaaa

SEQ ID NO: 138 - DNA, 32 bp, Leptinotarsa decemlineata
gactgcggttttgaacacccttcagaagttca

SEQ ID NO: 139 - DNA, 23 bp, Leptinotarsa decemlineata
tgtcaagccaaatctggtatggg

SEQ ID NO: 140 - DNA, 21 bp, Leptinotarsa decemlineata
ggcttctcaaagttgtagtta

SEQ ID NO: 141 - DNA, 23 bp, Leptinotarsa decemlineata
ccatcacggagaccaccaaactt

SEQ ID NO: 142 - DNA, 24 bp, Leptinotarsa decemlineata
aaaggcttctcaaagttgtagtta

SEQ ID NO: 143 - DNA, 23 bp, Leptinotarsa decemlineata
tgtgctattatcatgtttgatgt

SEQ ID NO: 144 - DNA, 23 bp, Leptinotarsa decemlineata
actgccggtcaggagaagtttgg

SEQ ID NO: 145 - DNA, 25 bp, Leptinotarsa decemlineata
aatacaactttgagaagcctttcct

SEQ ID NO: 146 - DNA, 23 bp, Leptinotarsa decemlineata
caggagaagtttggtggtctccg

SEQ ID NO: 147 - DNA, 21 bp, Leptinotarsa decemlineata
accaccaaacttctcctgacc

SEQ ID NO: 148 - DNA, 25 bp, Leptinotarsa decemlineata
ggtcaggagaagttggtggtctccg

SEQ ID NO: 149 - DNA, 28 bp, Leptinotarsa decemlineata
gcagcaatttcattgtgaggcagaccag

SEQ ID NO: 150 - DNA, 23 bp, Leptinotarsa decemlineata
atggagttcatcacgtcaatagc

SEQ ID NO: 151 - DNA, 32 bp, Leptinotarsa decemlineata
ggtctgcctcacaatgaaattgctgcccagat

SEQ ID NO: 152 - DNA, 34 bp, Leptinotarsa decemlineata
ctattgttttcgctgctatgggtgttaacatgga

SEQ ID NO: 153 - DNA, 29 bp, Leptinotarsa decemlineata
atgaactccattgctcgtggtcagaagat

SEQ ID NO: 154 - DNA, 26 bp, Leptinotarsa decemlineata
ataggaatctgggtgatggatccgtt

SEQ ID NO: 155 - DNA, 24 bp, Leptinotarsa decemlineata
tcctgtttctgaagatatgttggg

SEQ ID NO: 156 - DNA, 27 bp, Leptinotarsa decemlineata
tttgaagattgaagatttcttggaacg

SEQ ID NO: 157 - DNA, 23 bp, Leptinotarsa decemlineata
tcacaggcagcgaagatggtacc

SEQ ID NO: 158 - DNA, 21 bp, Leptinotarsa decemlineata
ttctttgaagtttttgaatat

SEQ ID NO: 159 - DNA, 112 bp, Leptinotarsa decemlineata
tctagaatgttgaatcaggctcgattgaaagtattgaaggttagggaagatcacgttcgtaccgtactagaggaggcgcgtaaacgacttggtcaggtcacaaacgcccggg

SEQ ID NO: 160 - DNA, 72 bp, Leptinotarsa decemlineata
tctagaaagatcacgttcgtaccgtactagaggaggcgcgtaaacgacttggtcaggtcacaaacgcccggg

SEQ ID NO: 161 - DNA, 312 bp, Leptinotarsa decemlineata
tctagaatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgcccggg

SEQ ID NO: 162 - DNA, 312 bp, Leptinotarsa decemlineata
tctagaaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgcccggg

SEQ ID NO: 163 - DNA, 395 bp, Leptinotarsa decemlineata
ggccccaagaagcatttgaagcgtttgaatgccccaaaagcatggatgttggataaattgggaggtgttttcgcacctcgcccatctacaggacctcacaaattgcgagagtctttgcccttggtgatcttcctacgtaaccgattgaagtatgctttgactaacagcgaagttactaagattgttatgcaaaggttaatcaaagtagatggaaaagtgaggaccgactccaattaccctgctgggtttatggatgttattaccattgaaaaaactggtgaatttttccgactcatctatgatgttaaaggacgatttgcagtgcatcgtattactgctgaggaagcaaagtacaaactatgcaaagtcaggaggatgcaaactggccccaaagg

SEQ ID NO: 164 - DNA, 45 bp, artificial sequence
  Description of artificial sequence:  synthetic primer
gcgtaatacgactcactataggggccccaagaagcatttgaagcg

SEQ ID NO: 165 - DNA, 21 bp, artificial sequence
  Description of artificial sequence:  synthetic primer
cctttggggccagtttgcatc

SEQ ID NO: 166 - DNA, 23 bp, artificial sequence
  Description of artificial sequence:  synthetic primer
ggccccaagaagcatttgaagcg

SEQ ID NO: 167 - DNA, 43 bp, artificial sequence
  Description of artificial sequence:  synthetic primer
gcgtaatacgactcactataggcctttggggccagtttgcatc

SEQ ID NO: 168 - DNA, 162 bp, Leptinotarsa decemlineata
gtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgctt

SEQ ID NO: 169 - DNA, 46 bp, artificial sequence
  Description of artificial sequence:  synthetic primer
gcgtaatacgactcactatagggtccacgtccaagtttttatgggc

SEQ ID NO: 170 - DNA, 25 bp, artificial sequence
  Description of artificial sequence:  synthetic primer
aagcgattagaaaaaaatcagttgc

SEQ ID NO: 171 - DNA, 24 bp, artificial sequence
  Description of artificial sequence:  synthetic primer
gtccacgtccaagtttttatgggc

SEQ ID NO: 172 - DNA, 47 bp, artificial sequence
  Description of artificial sequence:  synthetic primer
gcgtaatacgactcactataggaagcgattagaaaaaaatcagttgc

SEQ ID NO: 173 - DNA, 463 bp, Leptinotarsa decemlineata
ggtgaccaccaccgaatggagatttgagcgagaagtcaatatgcttctgggaatcaagtctcacaatgaagcttggaatattcacgacctgcttacgaaccctgatatgtctttgacggaccagcacacgagcatgatggattgattttgcaagccccaacttgaaaacttgtgtttggagacgtcgttccaagaaatcttcaatcttcaaacccaagacgtaatcaagcttcatacgggtttcatccaacactccaatacgcaccaaccgacgaagaagagcattgccttcaaacaacctgcgctgatctttctcttccaaagtcagaagttctctggcagctttacggatttttgccaaggtatacttgactcgccacacttcacgtttgttcctaagaccatattctcctatgattttcaactcctgatcaagacgtgccttttcataaggtcgcctggg

SEQ ID NO: 174 - DNA, 45 bp, artificial sequence
  Description of artificial sequence:  synthetic primer
gcgtaatacgactcactataggcccaggcgaccttatgaaaaggc

SEQ ID NO: 175 - DNA, 21 bp, artificial sequence
  Description of artificial sequence:  synthetic primer
ggtgaccaccaccgaatggag

SEQ ID NO: 176 - DNA, 23 bp, artificial sequence
  Description of artificial sequence:  synthetic primer
cccaggcgaccttatgaaaaggc

SEQ ID NO: 177 - DNA, 43 bp, artificial sequence
  Description of artificial sequence:  synthetic primer
gcgtaatacgactcactataggggtgaccaccaccgaatggag

SEQ ID NO: 178 - DNA, 503 bp, Leptinotarsa decemlineata
ggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagc

SEQ ID NO: 179 - DNA, 44 bp, artificial sequence
  Description of artificial sequence:  synthetic primer
gcgtaatacgactcactataggggtgttggttgcttctggtgtg

SEQ ID NO: 180 - DNA, 24 bp, artificial sequence
  Description of artificial sequence:  synthetic primer
gcttcgattcggcatctttatagg

SEQ ID NO: 181 - DNA, 22 bp, artificial sequence
  Description of artificial sequence:  synthetic primer
ggtgttggttgcttctggtgtg

SEQ ID NO: 182 - DNA, 46 bp, artificial sequence
  Description of artificial sequence:  synthetic primer
gcgtaatacgactcactatagggcttcgattcggcatctttatagg

SEQ ID NO: 183 - DNA, 883 bp, Leptinotarsa decemlineata
gactggcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagg

SEQ ID NO: 184 - DNA, 43 bp, artificial sequence
  Description of artificial sequence:  synthetic primer
gcgtaatacgactcactatagggactggcggttttgaacaccc

SEQ ID NO: 185 - DNA, 21 bp, artificial sequence
  Description of artificial sequence:  synthetic primer
cctttcaatgtccatgccacg

SEQ ID NO: 186 - DNA, 21 bp, artificial sequence
  Description of artificial sequence:  synthetic primer
gactggcggttttgaacaccc

SEQ ID NO: 187 - DNA, 43 bp, artificial sequence
  Description of artificial sequence:  synthetic primer
gcgtaatacgactcactataggcctttcaatgtccatgccacg

SEQ ID NO: 188 - DNA, 1505 bp, Leptinotarsa decemlineata
gcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatag

SEQ ID NO: 189 - DNA, 41 bp, artificial sequence
  Description of artificial sequence:  synthetic primer
gcgtaatacgactcactatagggcttgttgcccccgaatgc

SEQ ID NO: 190 - DNA, 22 bp, artificial sequence
  Description of artificial sequence:  synthetic primer
ctatcgggttggatggaactcg

SEQ ID NO: 191 - DNA, 19 bp, artificial sequence
  Description of artificial sequence:  synthetic primer
gcttgttgcccccgaatgc

SEQ ID NO: 192 - DNA, 44 bp, artificial sequence
  Description of artificial sequence:  synthetic primer
gcgtaatacgactcactataggctatcgggttggatggaactcg

SEQ ID NO: 193 - DNA, 427 bp, Leptinotarsa decemlineata
gccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttcc

SEQ ID NO: 194 - DNA, 45 bp, artificial sequence
  Description of artificial sequence:  synthetic primer
gcgtaatacgactcactatagggccataggaaaggcttctcaaag

SEQ ID NO: 195 - DNA, 25 bp, artificial sequence
  Description of artificial sequence:  synthetic primer
ggaaaaacgacatttgtgaaacgtc

SEQ ID NO: 196 - DNA, 23 bp, artificial sequence
  Description of artificial sequence:  synthetic primer
gccataggaaaggcttctcaaag

SEQ ID NO: 197 - DNA, 47 bp, artificial sequence
  Description of artificial sequence:  synthetic primer
gcgtaatacgactcactataggggaaaaacgacatttgtgaaacgtc

SEQ ID NO: 198 - DNA, 563 bp, Leptinotarsa decemlineata
tttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgc

SEQ ID NO: 199 - DNA, 45 bp, artificial sequence
  Description of artificial sequence:  synthetic primer
gcgtaatacgactcactataggtttcattgaacaagaggcaaacg

SEQ ID NO: 200 - DNA, 22 bp, artificial sequence
  Description of artificial sequence:  synthetic primer
gcgaaatcagctccagacgagc

SEQ ID NO: 201 - DNA, 23 bp, artificial sequence
  Description of artificial sequence:  synthetic primer
tttcattgaacaagaggcaaacg

SEQ ID NO: 202 - DNA, 44 bp, artificial sequence
  Description of artificial sequence:  synthetic primer
gcgtaatacgactcactatagggcgaaatcagctccagacgagc

SEQ ID NO: 203 - DNA, 100 bp, Leptinotarsa decemlineata
atgttgaatcaggctcgattgaaagtattgaaggttagggaagatcacgttcgtaccgtactagaggaggcgcgtaaacgacttggtcaggtcacaaacg

SEQ ID NO: 204 - DNA, 43 bp, artificial sequence
  Description of artificial sequence:  synthetic primer
gcgtaatacgactcactataggatgttgaatcaggctcgattg

SEQ ID NO: 205 - DNA, 21 bp, artificial sequence
  Description of artificial sequence:  synthetic primer
cgtttgtgacctgaccaagtc

SEQ ID NO: 206 - DNA, 21 bp, artificial sequence
  Description of artificial sequence:  synthetic primer
atgttgaatcaggctcgattg

SEQ ID NO: 207 - DNA, 43 bp, artificial sequence
  Description of artificial sequence:  synthetic primer
gcgtaatacgactcactataggcgtttgtgacctgaccaagtc

SEQ ID NO: 208 - DNA, 60 bp, Leptinotarsa decemlineata
aagatcacgttcgtaccgtactagaggaggcgcgtaaacgacttggtcaggtcacaaacg

SEQ ID NO: 209 - DNA, 43 bp, artificial sequence
  Description of artificial sequence:  synthetic primer
gcgtaatacgactcactataggaagatcacgttcgtaccgtac

SEQ ID NO: 210 - DNA, 19 bp, artificial sequence
  Description of artificial sequence:  synthetic primer
cgtttgtgacctgaccaag

SEQ ID NO: 211 - DNA, 21 bp, artificial sequence
  Description of artificial sequence:  synthetic primer
aagatcacgttcgtaccgtac

SEQ ID NO: 212 - DNA, 41 bp, artificial sequence
  Description of artificial sequence:  synthetic primer
gcgtaatacgactcactataggcgtttgtgacctgaccaag

SEQ ID NO: 213 - DNA, 302 bp, Leptinotarsa decemlineata
aatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgc

SEQ ID NO: 214 - DNA, 302 bp, Leptinotarsa decemlineata
aaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgc

SEQ ID NO: 215 - DNA, 203 bp, Leptinotarsa decemlineata
cgccggagagtttttgtcagcttcttcaaaagctttgcgcaagttactctcagactcgccagcgagtttgctcatgatctccggcccgtttatcaagaagaagaacgccccagtctcattagccacggcgcgagcaatcagggtcttacccgtaccagggggaccatacagcagtatacccctagggggcttcacgccgatag

SEQ ID NO: 216 - DNA, 43 bp, artificial sequence
  Description of artificial sequence:  synthetic primer
gcgtaatacgactcactataggcgccggagagtttttgtcagc

SEQ ID NO: 217 - DNA, 19 bp, artificial sequence
  Description of artificial sequence:  synthetic primer
ctatcggcgtgaagccccc

SEQ ID NO: 218 - DNA, 21 bp, artificial sequence
  Description of artificial sequence:  synthetic primer
cgccggagagtttttgtcagc

SEQ ID NO: 219 - DNA, 41 bp, artificial sequence
  Description of artificial sequence:  synthetic primer
gcgtaatacgactcactataggctatcggcgtgaagccccc

SEQ ID NO: 220 - DNA, 903 bp, Leptinotarsa decemlineata
ggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattacc

SEQ ID NO: 221 - DNA, 49 bp, artificial sequence
  Description of artificial sequence:  synthetic primer
gcgtaatacgactcactataggggcatagtcaatataggaatctgggtg

SEQ ID NO: 222 - DNA, 26 bp, artificial sequence
  Description of artificial sequence:  synthetic primer
ggtaatcctcgaagatgttaagttcc

SEQ ID NO: 223 - DNA, 27 bp, artificial sequence
  Description of artificial sequence:  synthetic primer
ggcatagtcaatataggaatctgggtg

SEQ ID NO: 224 - DNA, 48 bp, artificial sequence
  Description of artificial sequence:  synthetic primer
gcgtaatacgactcactataggggtaatcctcgaagatgttaagttcc

SEQ ID NO: 225 - DNA, 708 bp, Leptinotarsa decemlineata
ggagtcgcagaaatacgagagcaccttctcgaacaaccaagcctccttgagggtaaaacaagcccagtctgaggactcgggacactacactttgttggcggagaaccctcaaggctgcatagtgtcatctgcttacttagccatagaaccggtaaccacccaggaagggttgatccacgagtccaccttcaagcagcaacagaccgaaatggagcaaatcgacaccagcaagaccttggcgcctaacttcgtcagggtttgcggggatagagacgtgaccgagggcaagatgacccgcttcgactgtcgcgtcactggtcgtccttatccagacgtgacatggtacataaacggtcgacaagtcaccgacgaccacaaccacaagattttggttaacgaatccggaaaccatgccctgatgatcaccaccgtgagcaggaacgactcaggagtagtgacctgcgtcgccaggaacaagacgggagaaacctccttccagtgcaaccttaacgtcatcgaaaaggaacaggtagtcgcgcccaagttcgtggagagatttaccacagtcaacgtggcagaaggagaaccagtgtctctgcgcgctagagctgttggcacgccggtgccgcgaatcacttggcagagggacggggcgcccctagccagcgggcccgacgttcgcatcgcgattgacggtggagcctctac

SEQ ID NO: 226 - DNA, 46 bp, artificial sequence
  Description of artificial sequence:  synthetic primer
gcgtaatacgactcactataggggagtcgcagaaatacgagagcac

SEQ ID NO: 227 - DNA, 23 bp, artificial sequence
  Description of artificial sequence:  synthetic primer
gtagaggctccaccgtcaatcgc

SEQ ID NO: 228 - DNA, 24 bp, artificial sequence
  Description of artificial sequence:  synthetic primer
ggagtcgcagaaatacgagagcac

SEQ ID NO: 229 - DNA, 45 bp, artificial sequence
  Description of artificial sequence:  synthetic primer
gcgtaatacgactcactatagggtagaggctccaccgtcaatcgc

SEQ ID NO: 230 - DNA, 967 bp, Leptinotarsa decemlineata
gggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccga

SEQ ID NO: 231 - DNA, 42 bp, artificial sequence
  Description of artificial sequence:  synthetic primer
gcgtaatacgactcactatagggggagcagacgatcggttgg

SEQ ID NO: 232 - DNA, 23 bp, artificial sequence
  Description of artificial sequence:  synthetic primer
tcggacagactcgttcatttccc

SEQ ID NO: 233 - DNA, 20 bp, artificial sequence
  Description of artificial sequence:  synthetic primer
gggagcagacgatcggttgg

SEQ ID NO: 234 - DNA, 45 bp, artificial sequence
  Description of artificial sequence:  synthetic primer
gcgtaatacgactcactataggtcggacagactcgttcatttccc

SEQ ID NO: 235 - DNA, 258 bp, Leptinotarsa decemlineata
agatacccagatcatatgaaacggcatgactttttcaagagtgccatgcccgaaggttatgtacaggaaagaactatatttttcaaagatgacgggaactacaagacacgtaagtttaaacagttcggtactaactaaccatacatatttaaattttcaggtgctgaagtcaagtttgaaggtgatacccttgttaatagaatcgagttaaaaggtattgattttaaagaagatggaaacattcttggacacaaattg

SEQ ID NO: 236 - DNA, 46 bp, artificial sequence
  Description of artificial sequence:  synthetic primer
gcgtaatacgactcactataggagatacccagatcatatgaaacgg

SEQ ID NO: 237 - DNA, 24 bp, artificial sequence
  Description of artificial sequence:  synthetic primer
caatttgtgtccaagaatgtttcc

SEQ ID NO: 238 - DNA, 24 bp, artificial sequence
  Description of artificial sequence:  synthetic primer
agatacccagatcatatgaaacgg

SEQ ID NO: 239 - DNA, 46 bp, artificial sequence
  Description of artificial sequence:  synthetic primer
gcgtaatacgactcactataggcaatttgtgtccaagaatgtttcc

SEQ ID NO: 240 - DNA, 1961 bp, Leptinotarsa decemlineata
gcccttgcaatgtcatccatcatgtcgtgtacattgtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgcttcttccgcttcagcgcttgcatggccgctcaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgagcggccatgcaagcgctgaagcggaagaagcgattagaaaaaaatcagttgcaaatagatggcactttaactactattgaacttcaacgagaagctctggagggagctagtacgaacaccacagtattggaatctatgaaaaatgcagctgaagctcttaagaaagcccataaaaacttggacgtggacaatgtacacgacatgatggatgacattgcaagggc

SEQ ID NO: 241 - DNA, 2640 bp, Leptinotarsa decemlineata
gcccttggagcgagactacaacaactatggctggcaggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagcgaattggcgatcaagaagagcagttcgagaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcggcccttctcgaactgctcttcttgatcgccaattcgcttcgattcggcatctttataggaacgataaaacacggatcggaaaaatcctctttccacagcagacgcgttcagaataacagaatcttcttgattataaccagtataacaagcaatagcaactatactgttgatcccggctggtaattctctgaaccgcagatactccatagacctggtagtgaccagaggtttgtgcgggtagtatagcacgtgggccagggtgtccatccgcacgtggaaattcgtaatgtagacccccatagcttgcttacccatagcgctctggtaggtgttccttgggctctggttatgatcggggaaaggtataatagacgcgcaaacgcccaagatcatggccgggtggatttcgcagtgggtgtaggtcgtacaataagcatattctttgtcctgccgaagatcctcaggattcatcgcaatcatgacagtttcttcttcaagagtgtcgatgtattccaccacaccagaagcaaccaacacctgccagccatagttgttgtagtctcgctccaagggc

SEQ ID NO: 242 - DNA, 3584 bp, Leptinotarsa decemlineata
gcccttccgaagaaggatgtgaagggtacttacgtatccatacacagttcaggcttcagagattttttattgaaaccagaaattctaagagctatagttgactgcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagggtcaacattgtcttcaactatgatatgccagaggactccgacacctacttgcatcgaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctgggtcgaattcgcccttcgatgcaagtaggtgtcggagtcctctggcatatcatagttgaagacaatgttgaccctttcaatgtccatgccacgcccaaagagattcgtagctaccaatattctcttctggaaatctttgaactgctcataccgagacaacctctctttctggtccattcctctgtgaattcctatggctgggaaattctgttcagtcagcaactgtgccaaagccacacacctttgaacggacttcacaaaaatgaccacctgattaaattcgagaacatcgagcaactcaaataattttttattcttttcattttctttgagtttaacgtaatgctgttgtaatccgtgcaacgtcaatttggcttcatcgtctacatacacctccattggatcttgcatgaatttcttgcacaccggcctgatttctttgctgagtgtggcactgaacatcatcacttgcttggtgtgaggggtgtttctgtagatttcctggacgtctctcctcatatccaacagttctaacattttatcgcactcatcaagaatgaagtgtttcaggttcttgaggactagcttcctagacttgacaagcgccaaaatacgcccaggcgtccccacaacaatgtgtggacatttgtttttcaatacttcttcatcgttagcaataggcattcctccgaaaaagacgcccaccttgacactgggcatatatttactgaacctctcgtactctttgctgatttggaaagccagttcacgagtgtgacacatcaccaaaacgtaaacaacattgtccgctggttccaattgttgcagtgtcgccagaacaaacactgccgttttgcccataccagatttggcttgacataaaatgtccatgccaatgacagcttgaggaatacattcgtgctgaacttctgaagggtgttcaaaaccgcagtcaactatagctcttagaatttctggtttcaataaaaaatctctgaagcctgaactgtgtatggatacgtaagtacccttcacatccttcttcggaagggc

SEQ ID NO: 243 - DNA, 4723 bp, Leptinotarsa decemlineata
gcccttcgccattgggcgatggtttcgccatggaatatcagaatctggaagaacgtgtccatgagcagaattctatcgggttggatggaactcgtatccaaaagcacaggttctggtggtccattgaaactgtagctgtagagtatcggctggatcatgatcagcgactgcgtgaggtcttcgcgcataagcatgtgcctgtagaaggacgtttcgtcgggagaattgttaaacacctgcaggaactgtgaccttctcaaatggtacatgaactgcgggtagaggctgaagttttcgcccaagcggaacgaattcgggtcgtccttgttatattcgccgaatttctggcacagacgtatcaacatcctatcgacccatctcaaaacatcagggctatcgtctgattccgctctgtaaactgccatcctcgccattatcactgcggctgcctcctgatcgaatccagcactgacatgatgtatattagcggaagcatcggcccagtttctagcaactgtcgttactcggatcctcttctggccactagcatgctgatattgcgtgatgaactgtatgcagccccttcccccttgaggtatgggagcggaatgttggttgacgacctcgaagaacaaggccatggtagtacttggagttaccgtacacattttccactggaccgtgttacccattcctatttcggtgtcggaaaccaaaggattcttcacattcaacgaaacacaagatccaataccgccttgaattttcaactccctggaacacttgaccctccagagtaccattaaatgccatcttcagctcgtttttctgatctttcgaaaatatgcgctggaacgtttgcttgaacagggaagaattgaacgagtcgcccatgaccatatgtccccctgttgaattacaacactgtttcatctccatcaatcctgtctgatccaaagcgcatgaatatatgtcaacgcagtggccattcgttgctgctctcatcgctaaattatcatagtgcttgattgctttcttcatgtatttggcattgtctttttggatgtcgtggtgagatctgataggttgcttcagatcatcattcaagacttgaccagggccttgagagcaaggtcctccaacgaatagcatgaccctggcaccagtattggcgtatgtgcactccaacaacccaatggctatcgataaagctgtcccggtcgatctaagggcgcatttgccttggtggacaggccatgggtctctttgcaactctccaataagatcagtgaggttcatgtcgcatttcgagatgggttgaaggaacctgcttcctggtggcgtaggagcttgctggagtgctccaggcctcatgggttgtcctggttgttgaggagcaggttgagcacttactgcggctctgcccacttccaacatctcttgaacttgcttagctgtgaggtctttcgtccctcggaaaacgtaagatttgctgcagccctcggtacctagttcgtgcacttggaccatcttcccaaaggtaatcaaccctatcaaggcattcgggggcaacaagctcaaagacatctgcaacgaatccttgagagaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctggtcgaattcgcccttctctcaaggattcgttgcagatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgaaaccatcgcccaatggcgaagggc

SEQ ID NO: 244 - DNA, 2584 bp, Leptinotarsa decemlineata
gcccttgtggaagcagggctggcatggcgacaaattctagattgggatcaccaataagcttcctagctagccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttccagtacctccatctccgaccaacacacacttgaaagtgggaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcggaccactttgtacaagaaagctgggtcgaattcgcccttcccactttcaagtgtgtgttggtcggagatggaggtactggaaaaacgacatttgtgaaacgtcatatgactggtgaatttgaaaaaagatatgtagctactttgggagttgaagtccatcctctggtcttccatacaaacaggggccctattcggttcaatgtatgggacactgccggtcaggagaagtttggtggtctccgtgatggatattacattcagggacagtgtgctattatcatgtttgatgtaacttccagagttacatacaagaatgtaccaaattggcacagagatcttgtcagagtctgtgaaaatatcccgatagtactttgcgggaacaaggttgacatcaaagacagaaaagtaaaagcgaaaagtattgtctttcataggaagaagaatttgcagtactatgatatctctgccaaatctaactacaactttgagaagcctttcctatggctagctaggaagcttattggtgatcccaatctagaatttgtcgccatgccagccctgcttccacaagggc

SEQ ID NO: 245 - DNA, 2736 bp, Leptinotarsa decemlineata
gcccttcgcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcaacttctgcccgagatccgaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctgggtcgaattcgcccttcggatctcgggcagaagttgctgcgaaatcagctccagacgagcctccatagtattgctgatcttgattttgtttttctgcgccagcaggtcgattcccccggtggtttcttgggacagatggatttcgtcatcaattttcagatggatgtccttaccggtggcatctttatacttgttcgtgacggtgggaatgatggatttgaccagttctcggtcctggggccgaactcgaatggtaacatctttctcaaaaagctgatataatccctgcaaaatgaggctttccaggatttgggaatattttccctggtcgtttgtgacctgaccaagtcgtttacgcgcctcctctagtacggtacgaacgtgatcttccctaaccttcaatactttcaatcgagcctgattcaacatgttagacgattggatttttttctggagttcgacctgtttctctttcttctcataatattccataatcttgagacgttgttgctgaacaaggcgccccttttcaatattaaattcttcctcggccttggcatcgatttcttctgccttttcgtttgcctcttgttcaatgaaagccatcatatgcttgatctgcgaagggc

SEQ ID NO: 246 - DNA, 3435 bp, Leptinotarsa decemlineata
gcccttggaataggatgggtaatgtcgtcgttgggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattaccagaggaccgttcacaccagacacagtcaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgactgtgtctggtgtgaacggtcctctggtaatcctcgaagatgttaagttccccaagtacaatgaaatcgtacaactcaaactggctgatggcactatacgttcgggacaagttctggaagtcagtgggtcaaaagctgtggttcaagtgttcgagggcacatcaggaatcgacgccaaaaacaccgcttgtgaattcacaggagatattttgaggactcctgtttctgaagatatgttgggacgtgttttcaatggatcaggaaaacccatcgacaaaggtcccccaattttggctgaagacttcttggacatccagggtcaaccaatcaatccgtggtcccgtatctatcctgaggaaatgatccagacgggtattacagctattgacgtgatgaactccattgctcgtggtcagaagatccccattttctctgcagctggtctgcctcacaatgaaattgctgcccagatctgtagacaggctggtttagtcaagattcctggtaaatctgtacttgatgatcatgaagataactttgctattgttttcgctgctatgggtgttaacatggaaacagctaggttcttcaaacaggatttcgaagagaacggttctatggagaatgtctgcctgttcttgaatttggccaacgatcctaccattgaaagaattattacacctcgtctggctttgacagctgccgaattcttggcttaccaatgtgagaagcacgtcttggtcatcttgacagatatgtcttcgtatgcagaagctttgcgtgaggtatctgctgccagagaagaggtgcctggtcgtcgtggtttcccaggttacatgtacaccgatttagctaccatctatgaacgtgccggccgtgttgaaggacgtaacggatccatcacccagattcctatattgactatgcccaacgacgacattacccatcctattccaagggc

SEQ ID NO: 247 - DNA, 537 bp, Phaedon cochleariae
catttgaagcgtttagctgctcccaaagcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatctggcaacctctgcatgatcacggggagg

SEQ ID NO: 248 - protein, 161 aa, Phaedon cochleariae
AWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAVHRITAEEAKYKLCKVRRVQTGPKGIPFLVTHDGRTIRYPDPNIKVNDTIQMEIATSKILDYIKFES

SEQ ID NO: 249 - DNA, 477 bp, Phaedon cochleariae
ccctagacgtccctatgaaaaggcccgtctggatcaggaattgaaaattatcggcgcctttggtttacgaaacaaacgtgaagtgtggagagtaaagtacactttggctaaaatccgtaaagctgctcgtgaactgctcaccctagaagaaaaagagcctaaaagattgtttgaaggtaatgcacttctacgtcgtttggtgcgaattggtgttctggatgagaacaggatgaagcttgattatgttttgggtctgaaaattgaagatttcttggaaagaaggctccaaactcaggtgttcaaatctggtctggcaaagtcaattcatcatgctagagtactgattaggcagagacacatccgggtgcgcaagcaggtggtgaacatcccctcgttcatcgtgcggctggactcgcagaagcacatcgacttctccctgaagtcgcccttcgggggtggccgacctggccgtgtcaa

SEQ ID NO: 250 - protein, 158 aa, Phaedon cochleariae
PRRPYEKARLDQELKIIGAFGLRNKREVWRVKYTLAKIRKAARELLTLEEKEPKRLFEGNALLRRLVRIGVLDENRMKLDYVLGLKIEDFLERRLQTQVFKSGLAKSIHHARVLIRQRHIRVRKQVVNIPSFIVRLDSQKHIDFSLKSPFGGGRPGRV

SEQ ID NO: 251 - DNA, 504 bp, Phaedon cochleariae
tgcgatgcggcaaaaagaaggtgtggttggatccaaatgaaatcaacgaaatcgccaacaccaactcaagacaaaacatccgtaagctcatcaaggatggtcttatcatcaagaagccagtggcagtacactctagggcccgtgtacgcaagaacactgaagccagaaggaagggaaggcattgtggatttggaaagaggaagggtacggcaaatgcccgtatgcctcaaaaggaactgtgggtgcagcgcatgcgcgtcctcaggcgcctcctcaaaaagtacagggaggccaagaaaatcgaccgccatctttaccacgccctgtacatgaaagcgaagggtaacgtgttcaggaacaagagggtccttatggagtacatccacaagaagaaggcagagaaggccagggccaagatgctgtctgaccaggctaacgccaggagattgaaggtgaagcaggccagggaacgtagggaagagcgtatcgccaccaagaagcagg

SEQ ID NO: 252 - protein, 149 aa, Phaedon cochleariae
PNEINEIANTNSRQNIRKLIKDGLIIKKPVAVHSRARVRKNTEARRKGRHCGFGKRKGTANARMPQKELWVQRMRVLRRLLKKYREAKKIDRHLYHALYMKAKGNVFRNKRVLMEYIHKKKAEKARAKMLSDQANARRLKVKQARERRE

SEQ ID NO: 253 - DNA, 1594 bp, Phaedon cochleariae
ctctcaaggattctttgcagatgtcgctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccatggagagaccattgcccaatggcg

SEQ ID NO: 254 - protein, 530 aa, Phaedon cochleariae
LKDSLQMSLSLLPPNALIGLITFGKMVQVHELGTEGCSKSYVFCGTKDLTAKQVQEMLGIGKGSPNPQQQPGQPGRPGQNPQAAPVPPGSRFLQPVSKCDMNLTDLIGELQKDPWPVHQGKRPLRSTGAALSIAVGLLECTYPNTGGRIMIFLGGPCSQGPGQVLNDDLKQPIRSHHDIHKDNAKYMKKAIKHYDHLAMRAATNSHCIDIYSCALDQTGLMEMKQCCNSTGGHMVMGDSFNSSLFKQTFQRVFSKDPKNDLKMAFNATLEVKCSRELKVQGGIGSCVSLNVKSPLVSDTELGMGNTVQWKLCTLAPSSTVALFFEVVNQHSAPIPQGGRGCIQLITQYQHASGQRRIRVTTIARNWADATANIHHISAGFDQEAAAVVMARMAGYKAESDETPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 255 - DNA, 598 bp, Phaedon cochleariae
ctgatgttcaaaaacaaatcaaacacatgatggctttcattgaacaagaagccaatgagaaagcagaagaaattgatgccaaggcagaggaggaattcaacattgaaaaagggcgtttggtccagcaacagagactcaagatcatggagtactacgagaaaaaggagaagcaagtcgaacttcaaaagaaaattcagtcctctaatatgttgaatcaggctcgtttgaaggtgctgaaagtgagagaggaccatgtcagagcagtcctggaggatgctcgtaaaagtcttggtgaagtaaccaaagaccaaggaaaatactcccaaattttggagagcctaatcctacaaggactgttccagctgttcgagaaggaggtgacggtccgcgtgagaccgcaagacagggacctggtcaggtccatcctgcccaacgtcgctgccaaatacaaggacgccaccggcaaagacatcctactcaaggtggacgatgagtcgcacctgtctcaggagatcaccggaggcgtcgatttgctcgctcagaagaacaagatcaagatcagcaacacgatggaggctaggttggatctgatcgctca

SEQ ID NO: 256 - protein, 198 aa, Phaedon cochleariae
DVQKQIKHMMAFIEQEANEKAEEIDAKAEEEFNIEKGRLVQQQRLKIMEYYEKKEKQVELQKKIQSSNMLNQARLKVLKVREDHVRAVLEDARKSLGEVTKDQGKYSQILESLILQGLFQLFEKEVTVRVRPQDRDLVRSILPNVAAKYKDATGKDILLKVDDESHLSQEITGGVDLLAQKNKIKISNTMEARLDLIA

SEQ ID NO: 257 - DNA, 957 bp, Phaedon cochleariae
ggaataggatgggtgatgtcgtcgttgggcatagtcaagatggggatctgcgtgatggagccgttgcggccctccacacgaccggcgcgctcgtaaatggtggccagatcggtgtacatgtaaccggggaaacccctacggccgggcacttcttctcgagcggcagacacctcacgcaacgcctccgcgtacgacgacatgtcggtcaagatgaccagcacgtgcttctcgcactggtaggccaagaattcggcggccgtcagagccaaacgcggcgtgatgatgcgctcgatggtcggatcgttggccaagttcaagaacagacacacgttctccatcgagccgttctcttcgaagtcctgcttgaagaacctggcagtttccatgttgacacccatagcagcaaacacaatagcaaagttgtcttcatggtcatccagcacagacttgccaggtactttgaccaagccagcctgcctacaaatctgggctgcaatctcattgtggggcagcccagcggcggagaagatcggaatcttctgccctctggcgatagagttcatcacgtcgatggccgtgatcccagtctggatcatttcctcgggataaatacgcgaccacgggttgatcggctgtccttggatgtcgaggtagtcctcagccaggatcgggggacctttatcaatgggttttcctgatccattgaagacacgtcccagcatatcttctgatactggagttcttagaatatctccagtgaactcacacaccgtgttcttagcatcaatacctgatgtgccttcaaatacctgaacaactgcctttgatccactgacttccaaaacttgtccagatcgtagagttccatctgccaatttgagctggacaatttcattgaattttggaaacttgacatcctcaagaatgaccagtggtccgttcacaccagacacagtc

SEQ ID NO: 258 - protein, 302 aa, Phaedon cochleariae
LVILEDVKFPKFNEIVQLKLADGTLRSGQVLEVSGSKAVVQVFEGTSGIDAKNTVCEFTGDILRTPVSEDMLGRVFNGSGKPIDKGPPILAEDYLDIQGQPINPWSRIYPEEMIQTGITAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMP

SEQ ID NO: 259 - DNA, 922 bp, Phaedon cochleariae
gggccaagcacagtgaaatacagcaagctaacttgaaagcactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtgtctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgccgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcaattgctattatctgtactcgaatatcagactgcagtcatgcgacgagacttcccaacggctgatcgagtattgccttcaattccaaaagaacatcgcactagggtggcaca

SEQ ID NO: 260 - protein, 291 aa, Phaedon cochleariae
  misc_feature (263)..(263): Xaa can be any naturally occurring amino acid
QANLKVLPEGAEIRDGERLPVTVKDMGACEIYPQTIQHNPNGRFVVVCGDGEYIIYTAMALRNKAFGSAQEFVWAQDSSEYAIRESGSTIRIFKNFKEKKNFKSDFGAEGIYGGFLLGVKSVSGLAFYDWETLELVRRIEIQPRAIYWSDSGKLVCLATEDSYFILSYDSDQVQKARDNNQVAEDGVEAAFDVLGEINESVRTGLWVGDCFIYTNAVNRINYFVGGELVTIAHLDRPLYVLGYVPRDDRLYLVDKELGVVSYXIAIICTRISDCSHATRLPNGSSIAFNSK

SEQ ID NO: 261 - DNA, 23 bp, artificial sequence
  Description of artificial sequence:  synthetic primer
catttgaagcgtttwrmygcycc

SEQ ID NO: 262 - DNA, 28 bp, artificial sequence
  Description of artificial sequence:  synthetic primer
cttcgtgcccttgccratkatraabacg

SEQ ID NO: 263 - DNA, 26 bp, artificial sequence
  Description of artificial sequence:  synthetic primer
  misc_feature (18)..(18): n is a, c, g, or t
tcggtcttctcgaagacntaygtkac

SEQ ID NO: 264 - DNA, 27 bp, artificial sequence
  Description of artificial sequence:  synthetic primer
ccctggttcttcttvrrrttcttcctc

SEQ ID NO: 265 - DNA, 26 bp, artificial sequence
  Description of artificial sequence:  synthetic primer
tgcgatgcggcaaraaraaggtbtgg

SEQ ID NO: 266 - DNA, 26 bp, artificial sequence
  Description of artificial sequence:  synthetic primer
tcctgcttcttsgyrgcratwcgytc

SEQ ID NO: 267 - DNA, 25 bp, artificial sequence
  Description of artificial sequence:  synthetic primer
ctctcaaggattckytrcaratgtc

SEQ ID NO: 268 - DNA, 23 bp, artificial sequence
  Description of artificial sequence:  synthetic primer
cgccattgggcratggtytckcc

SEQ ID NO: 269 - DNA, 22 bp, artificial sequence
  Description of artificial sequence:  synthetic primer
cgcagatcaarcayatgatggc

SEQ ID NO: 270 - DNA, 21 bp, artificial sequence
  Description of artificial sequence:  synthetic primer
cggatctcgggcasmarytgc

SEQ ID NO: 271 - DNA, 24 bp, artificial sequence
  Description of artificial sequence:  synthetic primer
gactgtgtctggtgtraacggwcc

SEQ ID NO: 272 - DNA, 24 bp, artificial sequence
  Description of artificial sequence:  synthetic primer
ggaataggatgggtratrtcgtcg

SEQ ID NO: 273 - DNA, 23 bp, artificial sequence
  Description of artificial sequence:  synthetic primer
gggccaagcacwsygaaatrcag

SEQ ID NO: 274 - DNA, 23 bp, artificial sequence
  Description of artificial sequence:  synthetic primer
tgtgccaccctagtrcgrtgytc

SEQ ID NO: 275 - DNA, 23 bp, Phaedon cochleariae
aaaattgtcatgcaaaggttgat

SEQ ID NO: 276 - DNA, 21 bp, Phaedon cochleariae
aaagcatggatgttggacaaa

SEQ ID NO: 277 - DNA, 23 bp, Phaedon cochleariae
aaagcatggatgttggacaaatt

SEQ ID NO: 278 - DNA, 26 bp, Phaedon cochleariae
aaagcatggatgttggacaaattggg

SEQ ID NO: 279 - DNA, 32 bp, Phaedon cochleariae
aaagcatggatgttggacaaattggggggtgt

SEQ ID NO: 280 - DNA, 22 bp, Phaedon cochleariae
aaatacaagttgtgtaaagtaa

SEQ ID NO: 281 - DNA, 31 bp, Phaedon cochleariae
aagcatggatgttggacaaattggggggtgt

SEQ ID NO: 282 - DNA, 23 bp, Phaedon cochleariae
atggatgtcattactattgagaa

SEQ ID NO: 283 - DNA, 24 bp, Phaedon cochleariae
catcaaatttgaatctggcaacct

SEQ ID NO: 284 - DNA, 23 bp, Phaedon cochleariae
catgatggcagaaccattcgtta

SEQ ID NO: 285 - DNA, 22 bp, Phaedon cochleariae
ccaaagcatggatgttggacaa

SEQ ID NO: 286 - DNA, 23 bp, Phaedon cochleariae
ccatttttggtaacacatgatgg

SEQ ID NO: 287 - DNA, 23 bp, Phaedon cochleariae
cccaaagcatggatgttggacaa

SEQ ID NO: 288 - DNA, 24 bp, Phaedon cochleariae
cccaaagcatggatgttggacaaa

SEQ ID NO: 289 - DNA, 26 bp, Phaedon cochleariae
cccaaagcatggatgttggacaaatt

SEQ ID NO: 290 - DNA, 29 bp, Phaedon cochleariae
cccaaagcatggatgttggacaaattggg

SEQ ID NO: 291 - DNA, 35 bp, Phaedon cochleariae
cccaaagcatggatgttggacaaattggggggtgt

SEQ ID NO: 292 - DNA, 41 bp, Phaedon cochleariae
cccaaagcatggatgttggacaaattggggggtgtcttcgc

SEQ ID NO: 293 - DNA, 23 bp, Phaedon cochleariae
cgttaccctgaccccaacatcaa

SEQ ID NO: 294 - DNA, 25 bp, Phaedon cochleariae
gcaaaatacaagttgtgtaaagtaa

SEQ ID NO: 295 - DNA, 23 bp, Phaedon cochleariae
gcatggatgttggacaaattggg

SEQ ID NO: 296 - DNA, 25 bp, Phaedon cochleariae
gcatggatgttggacaaattggggg

SEQ ID NO: 297 - DNA, 29 bp, Phaedon cochleariae
gcatggatgttggacaaattggggggtgt

SEQ ID NO: 298 - DNA, 31 bp, Phaedon cochleariae
gcatggatgttggacaaattggggggtgtct

SEQ ID NO: 299 - DNA, 23 bp, Phaedon cochleariae
gctcccaaagcatggatgttgga

SEQ ID NO: 300 - DNA, 26 bp, Phaedon cochleariae
gctcccaaagcatggatgttggacaa

SEQ ID NO: 301 - DNA, 27 bp, Phaedon cochleariae
gctcccaaagcatggatgttggacaaa

SEQ ID NO: 302 - DNA, 32 bp, Phaedon cochleariae
gctcccaaagcatggatgttggacaaattggg

SEQ ID NO: 303 - DNA, 26 bp, Phaedon cochleariae
ggtcccaaaggaatcccatttttggt

SEQ ID NO: 304 - DNA, 21 bp, Phaedon cochleariae
ggtgtcttcgcccctcgtcca

SEQ ID NO: 305 - DNA, 28 bp, Phaedon cochleariae
gtgaagtcactaaaattgtcatgcaaag

SEQ ID NO: 306 - DNA, 23 bp, Phaedon cochleariae
tccaccgggcctcacaagttgcg

SEQ ID NO: 307 - DNA, 21 bp, Phaedon cochleariae
tcccaaagcatggatgttgga

SEQ ID NO: 308 - DNA, 27 bp, Phaedon cochleariae
tgctcccaaagcatggatgttggacaa

SEQ ID NO: 309 - DNA, 28 bp, Phaedon cochleariae
tggatgttggacaaattggggggtgtct

SEQ ID NO: 310 - DNA, 21 bp, Phaedon cochleariae
aaaattgaagatttcttggaa

SEQ ID NO: 311 - DNA, 23 bp, Phaedon cochleariae
aacaaacgtgaagtgtggagagt

SEQ ID NO: 312 - DNA, 23 bp, Phaedon cochleariae
aagtcgcccttcgggggtggccg

SEQ ID NO: 313 - DNA, 25 bp, Phaedon cochleariae
acttctccctgaagtcgcccttcgg

SEQ ID NO: 314 - DNA, 26 bp, Phaedon cochleariae
agattgtttgaaggtaatgcacttct

SEQ ID NO: 315 - DNA, 21 bp, Phaedon cochleariae
atccgtaaagctgctcgtgaa

SEQ ID NO: 316 - DNA, 23 bp, Phaedon cochleariae
atcgacttctccctgaagtcgcc

SEQ ID NO: 317 - DNA, 25 bp, Phaedon cochleariae
atcgacttctccctgaagtcgccct

SEQ ID NO: 318 - DNA, 51 bp, Phaedon cochleariae
atgaagcttgattatgttttgggtctgaaaattgaagatttcttggaaaga

SEQ ID NO: 319 - DNA, 21 bp, Phaedon cochleariae
attgaagatttcttggaaaga

SEQ ID NO: 320 - DNA, 23 bp, Phaedon cochleariae
cacatcgacttctccctgaagtc

SEQ ID NO: 321 - DNA, 38 bp, Phaedon cochleariae
cagaagcacatcgacttctccctgaagtcgcccttcgg

SEQ ID NO: 322 - DNA, 41 bp, Phaedon cochleariae
cagaagcacatcgacttctccctgaagtcgcccttcggggg

SEQ ID NO: 323 - DNA, 21 bp, Phaedon cochleariae
cgacttctccctgaagtcgcc

SEQ ID NO: 324 - DNA, 21 bp, Phaedon cochleariae
ctccctgaagtcgcccttcgg

SEQ ID NO: 325 - DNA, 35 bp, Phaedon cochleariae
ctggactcgcagaagcacatcgacttctccctgaa

SEQ ID NO: 326 - DNA, 26 bp, Phaedon cochleariae
gacttctccctgaagtcgcccttcgg

SEQ ID NO: 327 - DNA, 26 bp, Phaedon cochleariae
gctaaaatccgtaaagctgctcgtga

SEQ ID NO: 328 - DNA, 29 bp, Phaedon cochleariae
gctaaaatccgtaaagctgctcgtgaact

SEQ ID NO: 329 - DNA, 26 bp, Phaedon cochleariae
gtgcgcaagcaggtggtgaacatccc

SEQ ID NO: 330 - DNA, 29 bp, Phaedon cochleariae
tacactttggctaaaatccgtaaagctgc

SEQ ID NO: 331 - DNA, 23 bp, Phaedon cochleariae
tcgcagaagcacatcgacttctc

SEQ ID NO: 332 - DNA, 41 bp, Phaedon cochleariae
tcgcagaagcacatcgacttctccctgaagtcgcccttcgg

SEQ ID NO: 333 - DNA, 22 bp, Phaedon cochleariae
tctccctgaagtcgcccttcgg

SEQ ID NO: 334 - DNA, 23 bp, Phaedon cochleariae
tgaaaattgaagatttcttggaa

SEQ ID NO: 335 - DNA, 26 bp, Phaedon cochleariae
tgaaaattgaagatttcttggaaaga

SEQ ID NO: 336 - DNA, 31 bp, Phaedon cochleariae
tggactcgcagaagcacatcgacttctccct

SEQ ID NO: 337 - DNA, 22 bp, Phaedon cochleariae
tggctaaaatccgtaaagctgc

SEQ ID NO: 338 - DNA, 28 bp, Phaedon cochleariae
tgggtctgaaaattgaagatttcttgga

SEQ ID NO: 339 - DNA, 23 bp, Phaedon cochleariae
ttctccctgaagtcgcccttcgg

SEQ ID NO: 340 - DNA, 32 bp, Phaedon cochleariae
ttgggtctgaaaattgaagatttcttggaaag

SEQ ID NO: 341 - DNA, 23 bp, Phaedon cochleariae
gggtgcgcaagcaggtggtgaac

SEQ ID NO: 342 - DNA, 29 bp, Phaedon cochleariae
ctcctcaaaaagtacagggaggccaagaa

SEQ ID NO: 343 - DNA, 23 bp, Phaedon cochleariae
aaaaagaaggtgtggttggatcc

SEQ ID NO: 344 - DNA, 35 bp, Phaedon cochleariae
aaaaagaaggtgtggttggatccaaatgaaatcaa

SEQ ID NO: 345 - DNA, 32 bp, Phaedon cochleariae
aaagaaggtgtggttggatccaaatgaaatca

SEQ ID NO: 346 - DNA, 23 bp, Phaedon cochleariae
aacaccaactcaagacaaaacat

SEQ ID NO: 347 - DNA, 29 bp, Phaedon cochleariae
aacaccaactcaagacaaaacatccgtaa

SEQ ID NO: 348 - DNA, 23 bp, Phaedon cochleariae
aactcaagacaaaacatccgtaa

SEQ ID NO: 349 - DNA, 38 bp, Phaedon cochleariae
aagaacactgaagccagaaggaagggaaggcattgtgg

SEQ ID NO: 350 - DNA, 26 bp, Phaedon cochleariae
aatgaaatcaacgaaatcgccaacac

SEQ ID NO: 351 - DNA, 26 bp, Phaedon cochleariae
atggagtacatccacaagaagaaggc

SEQ ID NO: 352 - DNA, 21 bp, Phaedon cochleariae
caagatgctgtctgaccaggc

SEQ ID NO: 353 - DNA, 26 bp, Phaedon cochleariae
cgcctcctcaaaaagtacagggaggc

SEQ ID NO: 354 - DNA, 21 bp, Phaedon cochleariae
cgtatcgccaccaagaagcag

SEQ ID NO: 355 - DNA, 23 bp, Phaedon cochleariae
ctgtacatgaaagcgaagggtaa

SEQ ID NO: 356 - DNA, 22 bp, Phaedon cochleariae
gaacaagagggtccttatggag

SEQ ID NO: 357 - DNA, 30 bp, Phaedon cochleariae
gaacaagagggtccttatggagtacatcca

SEQ ID NO: 358 - DNA, 23 bp, Phaedon cochleariae
gagcgtatcgccaccaagaagca

SEQ ID NO: 359 - DNA, 23 bp, Phaedon cochleariae
gagtacatccacaagaagaaggc

SEQ ID NO: 360 - DNA, 23 bp, Phaedon cochleariae
gatccaaatgaaatcaacgaaat

SEQ ID NO: 361 - DNA, 29 bp, Phaedon cochleariae
gccaacaccaactcaagacaaaacatccg

SEQ ID NO: 362 - DNA, 38 bp, Phaedon cochleariae
gccaacaccaactcaagacaaaacatccgtaagctcat

SEQ ID NO: 363 - DNA, 37 bp, Phaedon cochleariae
ggcaaaaagaaggtgtggttggatccaaatgaaatca

SEQ ID NO: 364 - DNA, 28 bp, Phaedon cochleariae
gggtccttatggagtacatccacaagaa

SEQ ID NO: 365 - DNA, 22 bp, Phaedon cochleariae
tgcgatgcggcaaaaagaaggt

SEQ ID NO: 366 - DNA, 29 bp, Phaedon cochleariae
tggttggatccaaatgaaatcaacgaaat

SEQ ID NO: 367 - DNA, 26 bp, Phaedon cochleariae
ttggatccaaatgaaatcaacgaaat

SEQ ID NO: 368 - DNA, 21 bp, Phaedon cochleariae
ccgcagttcatgtaccatttg

SEQ ID NO: 369 - DNA, 29 bp, Phaedon cochleariae
ctgatggagatgaagcagtgctgcaattc

SEQ ID NO: 370 - DNA, 23 bp, Phaedon cochleariae
gacgtgctcagatgggtggacag

SEQ ID NO: 371 - DNA, 21 bp, Phaedon cochleariae
gcccgagcctgtgttgttgga

SEQ ID NO: 372 - DNA, 23 bp, Phaedon cochleariae
ggcacatgctgatgcgtgaggat

SEQ ID NO: 373 - DNA, 23 bp, Phaedon cochleariae
gggcacatggtcatgggcgattc

SEQ ID NO: 374 - DNA, 23 bp, Phaedon cochleariae
aagatcatggagtactacgagaa

SEQ ID NO: 375 - DNA, 21 bp, Phaedon cochleariae
acgagaaaaaggagaagcaag

SEQ ID NO: 376 - DNA, 32 bp, Phaedon cochleariae
atggagtactacgagaaaaaggagaagcaagt

SEQ ID NO: 377 - DNA, 26 bp, Phaedon cochleariae
caaaaacaaatcaaacacatgatggc

SEQ ID NO: 378 - DNA, 23 bp, Phaedon cochleariae
ctcaagatcatggagtactacga

SEQ ID NO: 379 - DNA, 26 bp, Phaedon cochleariae
ctcaagatcatggagtactacgagaa

SEQ ID NO: 380 - DNA, 23 bp, Phaedon cochleariae
gaacaagaagccaatgagaaagc

SEQ ID NO: 381 - DNA, 21 bp, Phaedon cochleariae
gactcaagatcatggagtact

SEQ ID NO: 382 - DNA, 32 bp, Phaedon cochleariae
gatgttcaaaaacaaatcaaacacatgatggc

SEQ ID NO: 383 - DNA, 22 bp, Phaedon cochleariae
tactacgagaaaaaggagaagc

SEQ ID NO: 384 - DNA, 23 bp, Phaedon cochleariae
ttcattgaacaagaagccaatga

SEQ ID NO: 385 - DNA, 23 bp, Phaedon cochleariae
acacgaccggcgcgctcgtaaat

SEQ ID NO: 386 - DNA, 41 bp, Phaedon cochleariae
accagcacgtgcttctcgcactggtaggccaagaattcggc

SEQ ID NO: 387 - DNA, 26 bp, Phaedon cochleariae
agcacgtgcttctcgcactggtaggc

SEQ ID NO: 388 - DNA, 23 bp, Phaedon cochleariae
atacgcgaccacgggttgatcgg

SEQ ID NO: 389 - DNA, 27 bp, Phaedon cochleariae
atcggtgtacatgtaaccggggaaacc

SEQ ID NO: 390 - DNA, 24 bp, Phaedon cochleariae
atcgttggccaagttcaagaacag

SEQ ID NO: 391 - DNA, 30 bp, Phaedon cochleariae
cacgtgcttctcgcactggtaggccaagaa

SEQ ID NO: 392 - DNA, 23 bp, Phaedon cochleariae
ccagtctggatcatttcctcggg

SEQ ID NO: 393 - DNA, 26 bp, Phaedon cochleariae
ccagtctggatcatttcctcgggata

SEQ ID NO: 394 - DNA, 37 bp, Phaedon cochleariae
cgctcgatggtcggatcgttggccaagttcaagaaca

SEQ ID NO: 395 - DNA, 53 bp, Phaedon cochleariae
cgctcgatggtcggatcgttggccaagttcaagaacagacacacgttctccat

SEQ ID NO: 396 - DNA, 28 bp, Phaedon cochleariae
cgtgcttctcgcactggtaggccaagaa

SEQ ID NO: 397 - DNA, 29 bp, Phaedon cochleariae
ctggcagtttccatgttgacacccatagc

SEQ ID NO: 398 - DNA, 21 bp, Phaedon cochleariae
cttagcatcaatacctgatgt

SEQ ID NO: 399 - DNA, 29 bp, Phaedon cochleariae
gacatgtcggtcaagatgaccagcacgtg

SEQ ID NO: 400 - DNA, 41 bp, Phaedon cochleariae
gacatgtcggtcaagatgaccagcacgtgcttctcgcactg

SEQ ID NO: 401 - DNA, 44 bp, Phaedon cochleariae
gacatgtcggtcaagatgaccagcacgtgcttctcgcactggta

SEQ ID NO: 402 - DNA, 23 bp, Phaedon cochleariae
gagccgttctcttcgaagtcctg

SEQ ID NO: 403 - DNA, 21 bp, Phaedon cochleariae
gatgaccagcacgtgcttctc

SEQ ID NO: 404 - DNA, 27 bp, Phaedon cochleariae
gatgaccagcacgtgcttctcgcactg

SEQ ID NO: 405 - DNA, 39 bp, Phaedon cochleariae
gatgaccagcacgtgcttctcgcactggtaggccaagaa

SEQ ID NO: 406 - DNA, 45 bp, Phaedon cochleariae
gatgaccagcacgtgcttctcgcactggtaggccaagaattcggc

SEQ ID NO: 407 - DNA, 21 bp, Phaedon cochleariae
gatggggatctgcgtgatgga

SEQ ID NO: 408 - DNA, 39 bp, Phaedon cochleariae
gatggggatctgcgtgatggagccgttgcggccctccac

SEQ ID NO: 409 - DNA, 35 bp, Phaedon cochleariae
ggaataggatgggtgatgtcgtcgttgggcatagt

SEQ ID NO: 410 - DNA, 37 bp, Phaedon cochleariae
ggaataggatgggtgatgtcgtcgttgggcatagtca

SEQ ID NO: 411 - DNA, 23 bp, Phaedon cochleariae
ggatcgttggccaagttcaagaa

SEQ ID NO: 412 - DNA, 25 bp, Phaedon cochleariae
ggatcgttggccaagttcaagaaca

SEQ ID NO: 413 - DNA, 26 bp, Phaedon cochleariae
ggatcgttggccaagttcaagaacag

SEQ ID NO: 414 - DNA, 26 bp, Phaedon cochleariae
ggatgggtgatgtcgtcgttgggcat

SEQ ID NO: 415 - DNA, 27 bp, Phaedon cochleariae
ggcagtttccatgttgacacccatagc

SEQ ID NO: 416 - DNA, 23 bp, Phaedon cochleariae
ggcatagtcaagatggggatctg

SEQ ID NO: 417 - DNA, 23 bp, Phaedon cochleariae
gtctggatcatttcctcgggata

SEQ ID NO: 418 - DNA, 62 bp, Phaedon cochleariae
gtgatgatgcgctcgatggtcggatcgttggccaagttcaagaacagacacacgttctccat

SEQ ID NO: 419 - DNA, 23 bp, Phaedon cochleariae
gtgtacatgtaaccggggaaacc

SEQ ID NO: 420 - DNA, 23 bp, Phaedon cochleariae
gtttccatgttgacacccatagc

SEQ ID NO: 421 - DNA, 26 bp, Phaedon cochleariae
tcaatgggttttcctgatccattgaa

SEQ ID NO: 422 - DNA, 22 bp, Phaedon cochleariae
tcatccagcacagacttgccag

SEQ ID NO: 423 - DNA, 23 bp, Phaedon cochleariae
tcatccagcacagacttgccagg

SEQ ID NO: 424 - DNA, 23 bp, Phaedon cochleariae
tccatgttgacacccatagcagc

SEQ ID NO: 425 - DNA, 29 bp, Phaedon cochleariae
tccatgttgacacccatagcagcaaacac

SEQ ID NO: 426 - DNA, 26 bp, Phaedon cochleariae
tcgaagtcctgcttgaagaacctggc

SEQ ID NO: 427 - DNA, 50 bp, Phaedon cochleariae
tcgatggtcggatcgttggccaagttcaagaacagacacacgttctccat

SEQ ID NO: 428 - DNA, 43 bp, Phaedon cochleariae
tcggatcgttggccaagttcaagaacagacacacgttctccat

SEQ ID NO: 429 - DNA, 23 bp, Phaedon cochleariae
tcgttggccaagttcaagaacag

SEQ ID NO: 430 - DNA, 23 bp, Phaedon cochleariae
tgggtgatgtcgtcgttgggcat

SEQ ID NO: 431 - DNA, 23 bp, Phaedon cochleariae
ttctcgcactggtaggccaagaa

SEQ ID NO: 432 - DNA, 32 bp, Phaedon cochleariae
ttctcttcgaagtcctgcttgaagaacctggc

SEQ ID NO: 433 - DNA, 29 bp, Phaedon cochleariae
ttggccaagttcaagaacagacacacgtt

SEQ ID NO: 434 - DNA, 29 bp, Phaedon cochleariae
gtttccatgttgacacccatagcagcaaa

SEQ ID NO: 435 - DNA, 21 bp, Phaedon cochleariae
atggatgttggacaaattggg

SEQ ID NO: 436 - DNA, 29 bp, Phaedon cochleariae
gctaaaatccgtaaagctgctcgtgaact

SEQ ID NO: 437 - DNA, 23 bp, Phaedon cochleariae
gagtaaagtacactttggctaaa

SEQ ID NO: 438 - DNA, 26 bp, Phaedon cochleariae
aaaatccgtaaagctgctcgtgaact

SEQ ID NO: 439 - DNA, 26 bp, Phaedon cochleariae
ctggactcgcagaagcacatcgactt

SEQ ID NO: 440 - DNA, 21 bp, Phaedon cochleariae
cgtctggatcaggaattgaaa

SEQ ID NO: 441 - DNA, 23 bp, Phaedon cochleariae
tggttggatccaaatgaaatcaa

SEQ ID NO: 442 - DNA, 26 bp, Phaedon cochleariae
gtgtggttggatccaaatgaaatcaa

SEQ ID NO: 443 - DNA, 29 bp, Phaedon cochleariae
cacatgatggctttcattgaacaagaagc

SEQ ID NO: 444 - DNA, 23 bp, Phaedon cochleariae
tacgagaaaaaggagaagcaagt

SEQ ID NO: 445 - DNA, 26 bp, Phaedon cochleariae
gtctggatcatttcctcgggataaat

SEQ ID NO: 446 - DNA, 26 bp, Phaedon cochleariae
ccagtctggatcatttcctcgggata

SEQ ID NO: 447 - DNA, 24 bp, Phaedon cochleariae
ccctgctggtttcatggatgtcat

SEQ ID NO: 448 - DNA, 23 bp, Phaedon cochleariae
attgaagatttcttggaaagaag

SEQ ID NO: 449 - DNA, 22 bp, Phaedon cochleariae
ttgaagatttcttggaaagaag

SEQ ID NO: 450 - DNA, 22 bp, Phaedon cochleariae
cttctttccaagaaatcttcaa

SEQ ID NO: 451 - DNA, 23 bp, Phaedon cochleariae
gactcgcagaagcacatcgactt

SEQ ID NO: 452 - DNA, 24 bp, Phaedon cochleariae
gactcgcagaagcacatcgacttc

SEQ ID NO: 453 - DNA, 21 bp, Phaedon cochleariae
tcgcagaagcacatcgacttc

SEQ ID NO: 454 - DNA, 23 bp, Phaedon cochleariae
cagaagcacatcgacttctccct

SEQ ID NO: 455 - DNA, 21 bp, Phaedon cochleariae
cttatggagtacatccacaag

SEQ ID NO: 456 - DNA, 22 bp, Phaedon cochleariae
aagaagaaggcagagaaggcca

SEQ ID NO: 457 - DNA, 23 bp, Phaedon cochleariae
gtgttcaataattctcctgatga

SEQ ID NO: 458 - DNA, 23 bp, Phaedon cochleariae
attttccatggagagaccattgc

SEQ ID NO: 459 - DNA, 21 bp, Phaedon cochleariae
gggcagaatccccaagctgcc

SEQ ID NO: 460 - DNA, 21 bp, Phaedon cochleariae
aatacaaggacgccaccggca

SEQ ID NO: 461 - DNA, 23 bp, Phaedon cochleariae
atgcccaacgacgacatcaccca

SEQ ID NO: 462 - DNA, 23 bp, Phaedon cochleariae
tgggtgatgtcgtcgttgggcat

SEQ ID NO: 463 - DNA, 23 bp, Phaedon cochleariae
ggtttccccggttacatgtacac

SEQ ID NO: 464 - DNA, 23 bp, Phaedon cochleariae
actatgcccaacgacgacatcac

SEQ ID NO: 465 - DNA, 23 bp, Phaedon cochleariae
ccgggcacttcttctcgagcggc

SEQ ID NO: 466 - DNA, 23 bp, Phaedon cochleariae
ccgaccatcgagcgcatcatcac

SEQ ID NO: 467 - DNA, 23 bp, Phaedon cochleariae
ttcttgaacttggccaacgatcc

SEQ ID NO: 468 - DNA, 22 bp, Phaedon cochleariae
tgttcttgaacttggccaacga

SEQ ID NO: 469 - DNA, 26 bp, Phaedon cochleariae
gctatgggtgtcaacatggaaactgc

SEQ ID NO: 470 - DNA, 21 bp, Phaedon cochleariae
tgctatgggtgtcaacatgga

SEQ ID NO: 471 - DNA, 25 bp, Phaedon cochleariae
ctattgtgtttgctgctatgggtgt

SEQ ID NO: 472 - DNA, 23 bp, Phaedon cochleariae
tacgagcgcgccggtcgtgtgga

SEQ ID NO: 473 - DNA, 483 bp, Phaedon cochleariae
gcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatct

SEQ ID NO: 474 - DNA, 23 bp, artificial sequence
  Description of artificial sequence:  synthetic primer
gcatggatgttggacaaattggg

SEQ ID NO: 475 - DNA, 54 bp, artificial sequence
  Description of artificial sequence:  synthetic primer
gcgtaatacgactcactataggagattcaaatttgatgtagtcaagaattttag

SEQ ID NO: 476 - DNA, 45 bp, artificial sequence
  Description of artificial sequence:  synthetic primer
gcgtaatacgactcactatagggcatggatgttggacaaattggg

SEQ ID NO: 477 - DNA, 32 bp, artificial sequence
  Description of artificial sequence:  synthetic primer
agattcaaatttgatgtagtcaagaattttag

SEQ ID NO: 478 - DNA, 477 bp, Phaedon cochleariae; identical to SEQ ID NO: 249

SEQ ID NO: 479 - DNA, 26 bp, artificial sequence
  Description of artificial sequence:  synthetic primer
ccctagacgtccctatgaaaaggccc

SEQ ID NO: 480 - DNA, 45 bp, artificial sequence
  Description of artificial sequence:  synthetic primer
gcgtaatacgactcactataggttgacacggccaggtcggccacc

SEQ ID NO: 481 - DNA, 48 bp, Phaedon cochleariae
gcgtaatacgactcactataggccctagacgtccctatgaaaaggccc

SEQ ID NO: 482 - DNA, 23 bp, artificial sequence
  Description of artificial sequence:  synthetic primer
ttgacacggccaggtcggccacc

SEQ ID NO: 483 - DNA, 449 bp, Phaedon cochleariae
atcctaatgaaatcaacgaaatcgccaacaccaactcaagacaaaacatccgtaagctcatcaaggatggtcttatcatcaagaagccagtggcagtacactctagggcccgtgtacgcaagaacactgaagctagaaggaagggaaggcattgtggatttggaaagaggaagggtacggcaaatgcccgtatgcctcaaaaggaactgtgggtgcagcgcatgcgcgtcctcaggcgcctcctcaaaaagtacagggaggccaagaaaatcgaccgccatctttaccacgccctgtacatgaaagcgaagggtaacgtgttcaggaacaagagggtccttatggagtacatccacaagaagaaggcagagaaggccagggccaagatgctgtctgaccaggctaacgccaggagattgaaggtgaagcaggccagggaacgtagggaa

SEQ ID NO: 484 - DNA, 26 bp, artificial sequence
  Description of artificial sequence:  synthetic primer
atcctaatgaaatcaacgaaatcgcc

SEQ ID NO: 485 - DNA, 47 bp, artificial sequence
  Description of artificial sequence:  synthetic primer
gcgtaatacgactcactataggttccctacgttccctggcctgcttc

SEQ ID NO: 486 - DNA, 48 bp, artificial sequence
  Description of artificial sequence:  synthetic primer
gcgtaatacgactcactataggatcctaatgaaatcaacgaaatcgcc

SEQ ID NO: 487 - DNA, 25 bp, artificial sequence
  Description of artificial sequence:  synthetic primer
ttccctacgttccctggcctgcttc

SEQ ID NO: 488 - DNA, 1546 bp, Phaedon cochleariae
gctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccat

SEQ ID NO: 489 - DNA, 24 bp, artificial sequence
  Description of artificial sequence:  synthetic primer
gctcagcctattaccgcccaacgc

SEQ ID NO: 490 - DNA, 48 bp, artificial sequence
  Description of artificial sequence:  synthetic primer
gcgtaatacgactcactataggatggaaaatgagtatctggaagaaag

SEQ ID NO: 491 - DNA, 46 bp, artificial sequence
  Description of artificial sequence:  synthetic primer
gcgtaatacgactcactatagggctcagcctattaccgcccaacgc

SEQ ID NO: 492 - DNA, 26 bp, artificial sequence
  Description of artificial sequence:  synthetic primer
atggaaaatgagtatctggaagaaag

SEQ ID NO: 493 - DNA, 598 bp, Phaedon cochleariae; identical to SEQ ID NO: 255

SEQ ID NO: 494 - DNA, 29 bp, artificial sequence
  Description of artificial sequence:  synthetic primer
ctgatgttcaaaaacaaatcaaacacatg

SEQ ID NO: 495 - DNA, 49 bp, artificial sequence
  Description of artificial sequence:  synthetic primer
gcgtaatacgactcactataggtgagcgatcagatccaacctagcctcc

SEQ ID NO: 496 - DNA, 51 bp, artificial sequence
  Description of artificial sequence:  synthetic primer
gcgtaatacgactcactataggctgatgttcaaaaacaaatcaaacacatg

SEQ ID NO: 497 - DNA, 27 bp, artificial sequence
  Description of artificial sequence:  synthetic primer
tgagcgatcagatccaacctagcctcc

SEQ ID NO: 498 - DNA, 909 bp, Phaedon cochleariae
actggtcattcttgaggatgtcaagtttccaaaattcaatgaaattgtccagctcaaattggcagatggaactctacgatctggacaagttttggaagtcagtggatcaaaggcagttgttcaggtatttgaaggcacatcaggtattgatgctaagaacacggtgtgtgagttcactggagatattctaagaactccagtatcagaagatatgctgggacgtgtcttcaatggatcaggaaaacccattgataaaggtcccccgatcctggctgaggactacctcgacatccaaggacagccgatcaacccgtggtcgcgtatttatcccgaggaaatgatccagactgggatcacggccatcgacgtgatgaactctatcgccagagggcagaagattccgatcttctccgccgctgggctgccccacaatgagattgcagcccagatttgtaggcaggctggcttggtcaaagtacctggcaagtctgtgctggatgaccatgaagacaactttgctattgtgtttgctgctatgggtgtcaacatggaaactgccaggttcttcaagcaggacttcgaagagaacggctcgatggagaacgtgtgtctgttcttgaacttggccaacgatccgaccatcgagcgcatcatcacgccgcgtttggctctgacggccgccgaattcttggcctaccagtgcgagaagcacgtgctggtcatcttgaccgacatgtcgtcgtacgcggaggcgttgcgtgaggtgtctgccgctcgagaagaagtgcccggccgtaggggtttccccggttacatgtacaccgatctggccaccatttacgagcgcgccggtcgtgtggagggccgcaacggctccatcacgcagatccccatcttgactatgcccaa

SEQ ID NO: 499 - DNA, 26 bp, artificial sequence
  Description of artificial sequence:  synthetic primer
actggtcattcttgaggatgtcaagt

SEQ ID NO: 500 - DNA, 49 bp, artificial sequence
  Description of artificial sequence:  synthetic primer
gcgtaatacgactcactataggttgggcatagtcaagatggggatctgc

SEQ ID NO: 501 - DNA, 48 bp, artificial sequence
  Description of artificial sequence:  synthetic primer
gcgtaatacgactcactataggactggtcattcttgaggatgtcaagt

SEQ ID NO: 502 - DNA, 27 bp, artificial sequence
  Description of artificial sequence:  synthetic primer
ttgggcatagtcaagatggggatctgc

SEQ ID NO: 503 - DNA, 877 bp, Phaedon cochleariae
  misc_feature (788)..(788): n is a, c, g, or t
caagctaacttgaaagtactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtttctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgctgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcnaattgctattatctgtactcgaatatcagactgcagtcatgcgacgagacttcccaacggctgatcgagtattgccttcaattccaaaa

SEQ ID NO: 504 - DNA, 29 bp, artificial sequence
  Description of artificial sequence:  synthetic primer
caagctaacttgaaagtactaccagaagg

SEQ ID NO: 505 - DNA, 51 bp, artificial sequence
  Description of artificial sequence:  synthetic primer
gcgtaatacgactcactataggttttggaattgaaggcaatactcgatcag

SEQ ID NO: 506 - DNA, 51 bp, artificial sequence
  Description of artificial sequence:  synthetic primer
gcgtaatacgactcactataggcaagctaacttgaaagtactaccagaagg

SEQ ID NO: 507 - DNA, 29 bp, artificial sequence
  Description of artificial sequence:  synthetic primer
ttttggaattgaaggcaatactcgatcag

SEQ ID NO: 508 - DNA, 2478 bp, Phaedon cochleariae
agattcaaatttgatgtagtcaagaattttagatgtagcaatttccatttgaattgtgtcattcactttgatgttggggtcagggtaacgaatggttctgccatcatgtgttaccaaaaatgggattcctttgggaccagtttggactctccttactttacacaacttgtattttgcctcttcagctgtaatacggtgcacagcaaatcttcctttaacatcatagatcagacggaaaaattcaccagtcttctcaatagtaatgacatccatgaaaccagcagggtaattagaatcagtcctcactttaccatcaactttgatcaacctttgcatgacaattttagtgacttcactgtttgtaagggcatacttcagcctgttacgaaggaaaatcactaaaggcagggattcgcgcaacttgtgaggcccggtggatggacgaggggcgaagacaccccccaatttgtccaacatccatgcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatct

SEQ ID NO: 509 - DNA, 4700 bp, Phaedon cochleariae
ctctcaaggattctttgcagatgtcgctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccatggagagaccattgcccaatggcgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcgccattgggcaatggtctctccatggaaaatgagtatctggaagaaagtgtccatgagcaggattctatccggctgaatagagcttgtgtccaacaacacaggctcgggcggcccgttgaagctgtaactgtacaaaatcggctggatcatgatcaaagactgagtcaaatcctcacgcatcagcatgtgcctataaaacgacgtttcatcaggagaattattgaacacctgcagaaactgcgaccgtctcaaatggtacatgaactgcggatacagactgaagttctcccccaacctgaacgaattcggatcgtctttattgtactctccgaacttctggcacagcctgatcaacatcctgtccacccatctgagcacgtcgggagtctcgtccgattccgccttgtaaccggccattcgggccatcacaactgccgccgcttcttggtcgaagccagcgctaatgtggtggatgttggcagtagcgtccgcccaatttctagcaatcgtggtcactctgatcctcctttgcccgctcgcgtgctgatactgggtgatgagctggatgcagcccctgcctccctgtggtatgggcgccgaatgctggttaaccacctcgaagaacagcgccacagtagagctcggcgccaacgtgcaaagtttccactgcacagtattccccatgcctagttccgtatcggaaaccagagggcttttaacgttcaaggacacgcacgagccgatgcccccttggacttttaactccctggaacacttcacctccaaggtggcgttgaacgccatcttgaggtcgttcttcgggtcttttgagaacactcgctggaaggtttgtttgaatagagaggaattgaaggaatcgcccatgaccatgtgccctccggtggaattgcagcactgcttcatctccatcagtcccgtctgatccagggcgcaggagtaaatgtcgatgcaatggctgttggtggcagctcgcattgccaagtgatcgtaatgtttgatagccttcttcatgtacttggcattgtctttgtgtatgtcatgatgggacctgatgggctgcttcaaatcgtcgttcaacacctggccgggaccctgagagcatggtcctcctaagaatatcatgattctgccacccgtattcggataggtgcattctaagaggccgacagcgatggacaatgctgcgcctgtggatctaagaggtcttttgccctgatgtacgggccaagggtctttctgcaactccccgatcagatctgtcaagttcatgtcgcattttgacacgggctgcaagaatctgctccccggtggtacaggggcagcttggggattctgccctggccgcccaggttgccctggctgttgttggggatttggtgacccttttccaatgcccaacatctcctggacttgcttggcggtgagatctttcgttccacagaacacgtacgacttgctgcagccttcggtacccagttcgtggacttgcaccatttttccgaacgtgatcaatccaatcaacgcgttgggcggtaataggctgagcgacatctgcaaagaatccttgagag

SEQ ID NO: 510 - DNA, 2726 bp, Phaedon cochleariae
cgcagatcaaacatatgatggctttcattgaacaagaagccaatgagaaagcagaagaaatcgatgccaaggcagaggaggaattcaacattgaaaaagggcgtttagtccagcaacagagactcaagatcatggagtactacgagaaaaaggagaagcaagtcgaacttcaaaagaaaattcagtcctctaatatgttgaatcaggctcgtttgaaggtgctgaaagtgagagaggaccatgtcagagcagtcctggaggatgctcgtaaaagtcttggtgaagtaaccaaagaccaaggaaaatactcccaaattttggagagcctaatcctacaaggactgttccagctgttcgagaaggaggtgacggtccgcgtgagaccgcaagatagggacttggttaggtccatcctgcccaacgtcgctgccaaatacaaggacgccaccggcaaagacatcctactcaaggtggacgatgagtcgcacctgtctcaggagatcaccggaggcgtcgatctgctcgctcagaagaacaagatcaagatcagcaacacgatggaggctaggttggatctgatcgctcagcaattggtgcccgagatccgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcggatctcgggcaccaattgctgagcgatcagatccaacctagcctccatcgtgttgctgatcttgatcttgttcttctgagcgagcagatcgacgcctccggtgatctcctgagacaggtgcgactcatcgtccaccttgagtaggatgtctttgccggtggcgtccttgtatttggcagcgacgttgggcaggatggacctaaccaagtccctatcttgcggtctcacgcggaccgtcacctccttctcgaacagctggaacagtccttgtaggattaggctctccaaaatttgggagtattttccttggtctttggttacttcaccaagacttttacgagcatcctccaggactgctctgacatggtcctctctcactttcagcaccttcaaacgagcctgattcaacatattagaggactgaattttcttttgaagttcgacttgcttctcctttttctcgtagtactccatgatcttgagtctctgttgctggactaaacgccctttttcaatgttgaattcctcctctgccttggcatcgatttcttctgctttctcattggcttcttgttcaatgaaagccatcatatgtttgatctgcg

SEQ ID NO: 511 - DNA, 3330 bp, Phaedon cochleariae
ttgggcatagtcaagatggggatctgcgtgatggagccgttgcggccctccacacgaccggcgcgctcgtaaatggtggccagatcggtgtacatgtaaccggggaaacccctacggccgggcacttcttctcgagcggcagacacctcacgcaacgcctccgcgtacgacgacatgtcggtcaagatgaccagcacgtgcttctcgcactggtaggccaagaattcggcggccgtcagagccaaacgcggcgtgatgatgcgctcgatggtcggatcgttggccaagttcaagaacagacacacgttctccatcgagccgttctcttcgaagtcctgcttgaagaacctggcagtttccatgttgacacccatagcagcaaacacaatagcaaagttgtcttcatggtcatccagcacagacttgccaggtactttgaccaagccagcctgcctacaaatctgggctgcaatctcattgtggggcagcccagcggcggagaagatcggaatcttctgccctctggcgatagagttcatcacgtcgatggccgtgatcccagtctggatcatttcctcgggataaatacgcgaccacgggttgatcggctgtccttggatgtcgaggtagtcctcagccaggatcgggggacctttatcaatgggttttcctgatccattgaagacacgtcccagcatatcttctgatactggagttcttagaatatctccagtgaactcacacaccgtgttcttagcatcaatacctgatgtgccttcaaatacctgaacaactgcctttgatccactgacttccaaaacttgtccagatcgtagagttccatctgccaatttgagctggacaatttcattgaattttggaaacttgacatcctcaagaatgaccagtaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttactggtcattcttgaggatgtcaagtttccaaaattcaatgaaattgtccagctcaaattggcagatggaactctacgatctggacaagttttggaagtcagtggatcaaaggcagttgttcaggtatttgaaggcacatcaggtattgatgctaagaacacggtgtgtgagttcactggagatattctaagaactccagtatcagaagatatgctgggacgtgtcttcaatggatcaggaaaacccattgataaaggtcccccgatcctggctgaggactacctcgacatccaaggacagccgatcaacccgtggtcgcgtatttatcccgaggaaatgatccagactgggatcacggccatcgacgtgatgaactctatcgccagagggcagaagattccgatcttctccgccgctgggctgccccacaatgagattgcagcccagatttgtaggcaggctggcttggtcaaagtacctggcaagtctgtgctggatgaccatgaagacaactttgctattgtgtttgctgctatgggtgtcaacatggaaactgccaggttcttcaagcaggacttcgaagagaacggctcgatggagaacgtgtgtctgttcttgaacttggccaacgatccgaccatcgagcgcatcatcacgccgcgtttggctctgacggccgccgaattcttggcctaccagtgcgagaagcacgtgctggtcatcttgaccgacatgtcgtcgtacgcggaggcgttgcgtgaggtgtctgccgctcgagaagaagtgcccggccgtaggggtttccccggttacatgtacaccgatctggccaccatttacgagcgcgccggtcgtgtggagggccgcaacggctccatcacgcagatccccatcttgactatgcccaa

SEQ ID NO: 512 - DNA, 3356 bp, Phaedon cochleariae
gggccaagcacagcgaaatgcagcaagctaacttgaaagcactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtgtctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgccgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcaattgctattatctgtactcgaatatcagactgcagtcatgcgacgagacttcccaacggctgatcgagtattgccttcaattccaaaagaacaccgcactagggtggcacaaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgccctttgtgccaccctagtgcggtgttcttttggaattgaaggcaatactcgatcagccgttgggaagtctcgtcgcatgactgcagtctgatattcgagtacagataatagcaattgatagctgactactcctaactctttatcaaccaagtataacctgtcatctctaggtacatagcccaggacatatagaggacggtccagatgtgcaatagttaccaattcaccacccacaaagtagttgatacggttgactgcgtttgtgtaaatgaagcagtctcctacccaaagacctgttcttacggattcatttatttcacctaggacatcaaaggcagcctccactccatcttcggcaacttggttgttatctctagctttctggacttggtcagagtcataggacaatatgaaatagctatcttcggtagcaaggcataccaacttgccactatctgaccagtagatagctctaggctgtatttcaatgcgccttactaactcaagcgtttcccagtcatagaaagctaagccagacactgatttcacacccaagagaaaaccaccatagattccttcggcaccaaagtcggacttgaaattctttttttctttgaaattcttgaagattcgaatggtggatccggattcgcggatggcatattcactggagtcctgtgcccatacaaattcttgagcgctaccaaatgctttgttacgaagggccatagccgtgtatattatgtattctccatcaccacaaaccactacaaaccgcccattggggttgtgttggattgtttgtgggtaaatctcgcatgctcccatgtcctttactgtgactggcaaacgttctccatctctgatttcagctccttctggtagtgctttcaagttagcttgctgcatttcgctgtgcttggccc

SEQ ID NO: 513 - DNA, 505 bp, Epilachna varivetis
tgcgatgcggcaagaagaaggtttggctggatcctaatgaaataactgaaattgctaatacaaactctagacaaaacatccgcaaactgattaaagatggtcttattattaaaaagcctgtcgcggtgcattctcgtgcacgtgtacgcaaaaatactgaagcccgcaggaaaggtcgtcattgtggatttggtaaaaggaaaggaactgcaaatgctaggatgcccagaaaggaattatggattcaacgtatgagagttctcagaaggttattgaagaaatatagggaagctaagaaaattgataggcatttataccatgctttatatatgaaagctaagggaaatgtattcaagaataagagagtaatgatggactatatccataaaaagaaggcggagaaagcacgtacaaagatgctcaatgatcaagctgatgcaaggaggctgaaagtcaaagaggcacgtaagcgacgtgaagagcgtatcgctacgaagaagcagga

SEQ ID NO: 514 - protein, 167 aa, Epilachna varivetis
RCGKKKVWLDPNEITEIANTNSRQNIRKLIKDGLIIKKPVAVHSRARVRKNTEARRKGRHCGFGKRKGTANARMPRKELWIQRMRVLRRLLKKYREAKKIDRHLYHALYMKAKGNVFKNKRVMMDYIHKKKAEKARTKMLNDQADARRLKVKEARKRREERIATKKQ

SEQ ID NO: 515 - DNA, 683 bp, Epilachna varivetis
ccaactctcgatccaagcattccaaaatacaggactgaagaatctataataggaacaaacccaggaatgggttttaggccaatgcccgacaacaacgaagaaagtaccctgatttggttacagggttctaataaaacaaactacgaaaaatggaaaatgaatctcctctcatatttagacaagtattacactcccggaaaaatagaaaagggaaatattccagtaaagcgctgttcatacggagaaaaattgattaggggacaagtatgtgatgtagatgtgaggaaatgggagccgtgcaccccggaaaatcattttgattacctcagaaatgcgccttgtatatttctgaagctgaacaggatatatggatgggaaccggagtactacaacgatccaaatgatcttccagatgatatgccgcagcagttgaaggaccatatacgttataatatcaccaatccagtggagagaaataccgtctgggtaacatgcgcaggtgaaaatccggcagacgtggagtacttgggccctgtgaagtattacccatctttccagggattccccggttactattttccatatttgaattctgaagggtacctaagtccattattggcggtacaattcaagagaccggtgtctggtattgttataaatatcgagtgcaaagcgtgggctgc

SEQ ID NO: 516 - protein, 227 aa, Epilachna varivetis
PTLDPSIPKYRTEESIIGTNPGMGFRPMPDNNEESTLIWLQGSNKTNYEKWKMNLLSYLDKYYTPGKIEKGNIPVKRCSYGEKLIRGQVCDVDVRKWEPCTPENHFDYLRNAPCIFLKLNRIYGWEPEYYNDPNDLPDDMPQQLKDHIRYNITNPVERNTVWVTCAGENPADVEYLGPVKYYPSFQGFPGYYFPYLNSEGYLSPLLAVQFKRPVSGIVINIECKAWA

SEQ ID NO: 517 - DNA, 743 bp, Epilachna varivetis
ctggcggccacatggtcatgggtgattcatttaactcttcacttttcaaacaaacatttcaacgagtattttcgaaagattccaatggagacttgaagatgtccttcaacgccatattagaagtgaagtgttctagagaacttaaagtacaaggaggtataggtccttgtgtctctctaaatgtcaaaaatcctcttgtttctgatttagaaataggcatgggtaacacagttcagtggaaactgtgtagcttaagtccaagcactacggttgccttatttttcgaagttgttaatcagcatgcagcacccattcctcaagggggacgtggatgcattcagtttattactcaatatcagcattcaagtggtcagaaaaaaataagggtaactacaatagcaagaaattgggcggatgccactgcaaatattcaccatattagcgctggctttgacgaacaaactgcggctgttttaatggcgaggatcgctgtatatagagcagaaactgatgagagttcagatgttctcagatgggttgacagaatgttgatacgattgtgtcagaaatttggagaatataacaaagatgacaccaacagcttcaggctcagtgaaaacttcagcttatatccacagtttatgtatcatctacgtcgttcccaatttctacaagtgttcaataattcaccagatgaaacttcattctataggcacatgttgatgagggaagatcgcaatcag

SEQ ID NO: 518 - protein, 247 aa, Epilachna varivetis
GGHMVMGDSFNSSLFKQTFQRVFSKDSNGDLKMSFNAILEVKCSRELKVQGGIGPCVSLNVKNPLVSDLEIGMGNTVQWKLCSLSPSTTVALFFEVVNQHAAPIPQGGRGCIQFITQYQHSSGQKKIRVTTIARNWADATANIHHISAGFDEQTAAVLMARIAVYRAETDESSDVLRWVDRMLIRLCQKFGEYNKDDTNSFRLSENFSLYPQFMYHLRRSQFLQVFNNSPDETSFYRHMLMREDRNQ

SEQ ID NO: 519 - DNA, 734 bp, Epilachna varivetis
cgccatccgtcgctgttcaaggcgatcggcgttaagcctccaaggggtattctcctttacgggcctcccggcacggggaaaacgctgatcgccagggccgttgccaacgaaactggtgcgttcttcttcctcatcaatgggcccgagattatgagcaagctggccggagaatccgagagcaatcttagaaaggcttttgaagaggctgataaaaactctcctgcaatcatctttatcgacgaattagacgcaatcgctcccaagcgcgagaagactcatggtgaggtagagagacgcatcgtctcccaactgttgactttgatggacggcatgaagaaaagttcccatgtgatcgtgatggcggccacgaacaggcccaattccatcgaccctgcactcagacgtttcggccgattcgacagagagatcgacatcggtatccccgacgctactggaagattagaagtactcagaatacacaccaaaaacatgaaattggctgacgatgtagatttggaacagattgccgcagagactcacggtcatgtaggtgctgacttggcttctttgtgctcagaggctgccttgcaacaaattagagaaaaaatggacctcatcgacttagatgatgagcagatcgatgccgaagtcctaaattctctggcagttaccatggagaacttccgttacgccatgtctaagagcagtccgagcgctttgcgcgaaaccgtcgt

SEQ ID NO: 520 - protein, 244 aa, Epilachna varivetis
RHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLDDEQIDAEVLNSLAVTMENFRYAMSKSSPSALRETV

SEQ ID NO: 521 - DNA, 799 bp, Epilachna varivetis
gactgtgtctggtgtgaacggaccgttggtgatccttgatagtgttaagtttccaaaatttaacgaaattgtacagctcaagttatcagatggaacagttaggtctggacaagttttggaagtcagtggacagaaggcggttgtccaagtttttgaaggcacctccggaattgatgctaaaaacactttatgtgaatttacaggagatatcttaagaactccagtgtctgaagatatgttgggtcgtgtgtttaatggatctggaaagcctatcgataaagggccgccaatcttagctgaagattttcttgacattcaaggtcaacctataaatccttggtctcgtatctatccagaagaaatgatccagactggtatttctgcgattgatgtgatgaattccattgccagaggacaaaagattccaattttctctgcagctggtttaccccacaatgaaatcgctgctcaaatctgtagacaagctggtcttgtcaaaatcccagggaaatctgtcttagatgatcatgaagacaactttgctatcgttttcgccgctatgggtgtcaatatggaaacagccagattcttcaagcaagattttgaagagaatggctctatggaaaatgtgtgcctatttttgaacttggccaatgatcctaccattgaaagaattataacaccccgtttgactttaacagcggctgaatttatggcatatcaatgtgagaagcatgtgttagtcatattgactgacatgtcatcttatgctgaggctttgcgtgaggtatctgctgct

SEQ ID NO: 522 - protein, 266 aa, Epilachna varivetis
TVSGVNGPLVILDSVKFPKFNEIVQLKLSDGTVRSGQVLEVSGQKAVVQVFEGTSGIDAKNTLCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLTLTAAEFMAYQCEKHVLVILTDMSSYAEALREVSAA

SEQ ID NO: 523 - DNA, 26 bp, artificial sequence
  Description of artificial sequence:  synthetic primer
tgcgatgcggcaaraaraaggtbtgg

SEQ ID NO: 524 - DNA, 26 bp, artificial sequence
  Description of artificial sequence:  synthetic primer
tcctgcttcttsgyrgcratwcgytc

SEQ ID NO: 525 - DNA, 25 bp, artificial sequence
  Description of artificial sequence:  synthetic primer
gggccgtggtcagaayatywayaac

SEQ ID NO: 526 - DNA, 20 bp, artificial sequence
  Description of artificial sequence:  synthetic primer
gcagcccacgcyytgcactc

SEQ ID NO: 527 - DNA, 23 bp, artificial sequence
  Description of artificial sequence:  synthetic primer
cggctgacgtggaaygtktggcc

SEQ ID NO: 528 - DNA, 24 bp, artificial sequence
  Description of artificial sequence:  synthetic primer
cggcgtattctccraayttctggc

SEQ ID NO: 529 - DNA, 21 bp, artificial sequence
  Description of artificial sequence:  synthetic primer
cgctgtcgcargcraaratgg

SEQ ID NO: 530 - DNA, 23 bp, artificial sequence
  Description of artificial sequence:  synthetic primer
cgatcaaagcgwccraavcgacg

SEQ ID NO: 531 - DNA, 21 bp, artificial sequence
  Description of artificial sequence:  synthetic primer
gttcaccggcgayatyctgcg

SEQ ID NO: 532 - DNA, 24 bp, artificial sequence
  Description of artificial sequence:  synthetic primer
cggcatagtcagaatsggratctg

SEQ ID NO: 533 - DNA, 23 bp, Epilachna varivetis
aagcgacgtgaagagcgtatcgc

SEQ ID NO: 534 - DNA, 23 bp, Epilachna varivetis
attaaagatggtcttattattaa

SEQ ID NO: 535 - DNA, 26 bp, Epilachna varivetis
cgtaagcgacgtgaagagcgtatcgc

SEQ ID NO: 536 - DNA, 26 bp, Epilachna varivetis
ggtcgtcattgtggatttggtaaaag

SEQ ID NO: 537 - DNA, 22 bp, Epilachna varivetis
tgcgatgcggcaagaagaaggt

SEQ ID NO: 538 - DNA, 21 bp, Epilachna varivetis
tgcggcaagaagaaggtttgg

SEQ ID NO: 539 - DNA, 21 bp, Epilachna varivetis
ttgtggatttggtaaaaggaa

SEQ ID NO: 540 - DNA, 21 bp, Epilachna varivetis
caagtgttcaataattcacca

SEQ ID NO: 541 - DNA, 23 bp, Epilachna varivetis
cattctataggcacatgttgatg

SEQ ID NO: 542 - DNA, 22 bp, Epilachna varivetis
ctggcggccacatggtcatggg

SEQ ID NO: 543 - DNA, 23 bp, Epilachna varivetis
aacaggcccaattccatcgaccc

SEQ ID NO: 544 - DNA, 24 bp, Epilachna varivetis
agagaaaaaatggacctcatcgac

SEQ ID NO: 545 - DNA, 29 bp, Epilachna varivetis
cgccatccgtcgctgttcaaggcgatcgg

SEQ ID NO: 546 - DNA, 36 bp, Epilachna varivetis
ctggcagttaccatggagaacttccgttacgccatg

SEQ ID NO: 547 - DNA, 23 bp, Epilachna varivetis
gtgatcgtgatggcggccacgaa

SEQ ID NO: 548 - DNA, 24 bp, Epilachna varivetis
gtgatcgtgatggcggccacgaac

SEQ ID NO: 549 - DNA, 22 bp, Epilachna varivetis
tgatggacggcatgaagaaaag

SEQ ID NO: 550 - DNA, 23 bp, Epilachna varivetis
aatatggaaacagccagattctt

SEQ ID NO: 551 - DNA, 23 bp, Epilachna varivetis
atgatccagactggtatttctgc

SEQ ID NO: 552 - DNA, 24 bp, Epilachna varivetis
attgatgtgatgaattccattgcc

SEQ ID NO: 553 - DNA, 26 bp, Epilachna varivetis
gaaatgatccagactggtatttctgc

SEQ ID NO: 554 - DNA, 23 bp, Epilachna varivetis
gaagaaatgatccagactggtat

SEQ ID NO: 555 - DNA, 21 bp, Epilachna varivetis
gactgtgtctggtgtgaacgg

SEQ ID NO: 556 - DNA, 23 bp, Epilachna varivetis
gatatgttgggtcgtgtgtttaa

SEQ ID NO: 557 - DNA, 23 bp, Epilachna varivetis
gatcctaccattgaaagaattat

SEQ ID NO: 558 - DNA, 26 bp, Epilachna varivetis
gtgtctgaagatatgttgggtcgtgt

SEQ ID NO: 559 - DNA, 21 bp, Epilachna varivetis
gtgtctggtgtgaacggaccg

SEQ ID NO: 560 - DNA, 23 bp, Epilachna varivetis
tctgaagatatgttgggtcgtgt

SEQ ID NO: 561 - DNA, 22 bp, Epilachna varivetis
tggcatatcaatgtgagaagca

SEQ ID NO: 562 - DNA, 26 bp, Epilachna varivetis
ttgaacttggccaatgatcctaccat

SEQ ID NO: 563 - DNA, 22 bp, Epilachna varivetis
ttaaagatggtcttattattaa

SEQ ID NO: 564 - DNA, 23 bp, artificial sequence
  Description of artificial sequence:  synthetic primer
gctatgggtgtcaatatggaaac

SEQ ID NO: 565 - DNA, 23 bp, artificial sequence
  Description of artificial sequence:  synthetic primer
ttcaataattcaccagatgaaac

SEQ ID NO: 566 - DNA, 21 bp, artificial sequence
  Description of artificial sequence:  synthetic primer
cgatcgccttgaacagcgacg

SEQ ID NO: 567 - DNA, 23 bp, artificial sequence
  Description of artificial sequence:  synthetic primer
gttaccatggagaacttccgtta

SEQ ID NO: 568 - DNA, 27 bp, artificial sequence
  Description of artificial sequence:  synthetic primer
gttaccatggagaacttccgttacgcc

SEQ ID NO: 569 - DNA, 24 bp, artificial sequence
  Description of artificial sequence:  synthetic primer
accatggagaacttccgttacgcc

SEQ ID NO: 570 - DNA, 21 bp, artificial sequence
  Description of artificial sequence:  synthetic primer
atggagaacttccgttacgcc

SEQ ID NO: 571 - DNA, 23 bp, artificial sequence
  Description of artificial sequence:  synthetic primer
tctgaagatatgttgggtcgtgt

SEQ ID NO: 572 - DNA, 24 bp, artificial sequence
  Description of artificial sequence:  synthetic primer
caaaagattccaattttctctgca

SEQ ID NO: 573 - DNA, 26 bp, artificial sequence
  Description of artificial sequence:  synthetic primer
ccccacaatgaaatcgctgctcaaat

SEQ ID NO: 574 - DNA, 23 bp, artificial sequence
  Description of artificial sequence:  synthetic primer
atcgttttcgccgctatgggtgt

SEQ ID NO: 575 - DNA, 26 bp, artificial sequence
  Description of artificial sequence:  synthetic primer
ttcaagcaagattttgaagagaatgg

SEQ ID NO: 576 - DNA, 376 bp, Epilachna varivetis
gacaaaacatccgcaaactgattaaagatggtcttattattaaaaagcctgtcgcggtgcattctcgtgcacgtgtacgcaaaaatactgaagcccgcaggaaaggtcgtcattgtggatttggtaaaaggaaaggaactgcaaatgctaggatgcccagaaaggaattatggattcaacgtatgagagttctcagaaggttattgaagaaatatagggaagctaagaaaattgataggcatttataccatgctttatatatgaaagctaagggaaatgtattcaagaataagagagtaatgatggactatatccataaaaagaaggcggagaaagcacgtacaaagatgctcaatgatcaagctgatgcaaggag

SEQ ID NO: 577 - DNA, 20 bp, artificial sequence
  Description of artificial sequence:  synthetic primer
gacaaaacatccgcaaactg

SEQ ID NO: 578 - DNA, 42 bp, artificial sequence
  Description of artificial sequence:  synthetic primer
gcgtaatacgactcactataggctccttgcatcagcttgatc

SEQ ID NO: 579 - DNA, 42 bp, artificial sequence
  Description of artificial sequence:  synthetic primer
gcgtaatacgactcactatagggacaaaacatccgcaaactg

SEQ ID NO: 580 - DNA, 20 bp, artificial sequence
  Description of artificial sequence:  synthetic primer
ctccttgcatcagcttgatc

SEQ ID NO: 581 - DNA, 529 bp, Epilachna varivetis
caggactgaagaatctataataggaacaaacccaggaatgggttttaggccaatgcccgacaacaacgaagaaagtaccctgatttggttacagggttctaataaaacaaactacgaaaaatggaaaatgaatctcctctcatatttagacaagtattacactcccggaaaaatagaaaagggaaatattccagtaaagcgctgttcatacggagaaaaattgattaggggacaagtatgtgatgtagatgtgaggaaatgggagccgtgcaccccggaaaatcattttgattacctcagaaatgcgccttgtatatttctgaagctgaacaggatatatggatgggaaccggagtactacaacgatccaaatgatcttccagatgatatgccgcagcagttgaaggaccatatacgttataatatcaccaatccagtggagagaaataccgtctgggtaacatgcgcaggtgaaaatccggcagacgtggagtacttgggccctgtgaagtattacccatctttccag

SEQ ID NO: 582 - DNA, 24 bp, artificial sequence
  Description of artificial sequence:  synthetic primer
caggactgaagaatctataatagg

SEQ ID NO: 583 - DNA, 44 bp, artificial sequence
  Description of artificial sequence:  synthetic primer
gcgtaatacgactcactataggctggaaagatgggtaatacttc

SEQ ID NO: 584 - DNA, 46 bp, artificial sequence
  Description of artificial sequence:  synthetic primer
gcgtaatacgactcactataggcaggactgaagaatctataatagg

SEQ ID NO: 585 - DNA, 22 bp, artificial sequence
  Description of artificial sequence:  synthetic primer
ctggaaagatgggtaatacttc

SEQ ID NO: 586 - DNA, 651 bp, Epilachna varivetis
ccaatggagacttgaagatgtccttcaacgccatattagaagtgaagtgttctagagaacttaaagtacaaggaggtataggtccttgtgtctctctaaatgtcaaaaatcctcttgtttctgatttagaaataggcatgggtaacacagttcagtggaaactgtgtagcttaagtccaagcactacggttgccttatttttcgaagttgttaatcagcatgcagcacccattcctcaagggggacgtggatgcattcagtttattactcaatatcagcattcaagtggtcagaaaaaaataagggtaactacaatagcaagaaattgggcggatgccactgcaaatattcaccatattagcgctggctttgacgaacaaactgcggctgttttaatggcgaggatcgctgtatatagagcagaaactgatgagagttcagatgttctcagatgggttgacagaatgttgatacgattgtgtcagaaatttggagaatataacaaagatgacaccaacagcttcaggctcagtgaaaacttcagcttatatccacagtttatgtatcatctacgtcgttcccaatttctacaagtgttcaataattcaccagatgaaacttcattctataggcacatgttgatgagggaag

SEQ ID NO: 587 - DNA, 22 bp, artificial sequence
  Description of artificial sequence:  synthetic primer
ccaatggagacttgaagatgtc

SEQ ID NO: 588 - DNA, 42 bp, artificial sequence
  Description of artificial sequence:  synthetic primer
gcgtaatacgactcactataggcttccctcatcaacatgtgc

SEQ ID NO: 589 - DNA, 44 bp, artificial sequence
  Description of artificial sequence:  synthetic primer
gcgtaatacgactcactataggccaatggagacttgaagatgtc

SEQ ID NO: 590 - DNA, 20 bp, artificial sequence
  Description of artificial sequence:  synthetic primer
cttccctcatcaacatgtgc

SEQ ID NO: 591 - DNA, 545 bp, Epilachna varivetis
gttaagcctccaaggggtattctcctttacgggcctcccggcacggggaaaacgctgatcgccagggccgttgccaacgaaactggtgcgttcttcttcctcatcaatgggcccgagattatgagcaagctggccggagaatccgagagcaatcttagaaaggcttttgaagaggctgataaaaactctcctgcaatcatctttatcgacgaattagacgcaatcgctcccaagcgcgagaagactcatggtgaggtagagagacgcatcgtctcccaactgttgactttgatggacggcatgaagaaaagttcccatgtgatcgtgatggcggccacgaacaggcccaattccatcgaccctgcactcagacgtttcggccgattcgacagagagatcgacatcggtatccccgacgctactggaagattagaagtactcagaatacacaccaaaaacatgaaattggctgacgatgtagatttggaacagattgccgcagagactcacggtcatgtaggtgctgacttggcttctttgtgctc

SEQ ID NO: 592 - DNA, 22 bp, artificial sequence
  Description of artificial sequence:  synthetic primer
gttaagcctccaaggggtattc

SEQ ID NO: 593 - DNA, 44 bp, artificial sequence
  Description of artificial sequence:  synthetic primer
gcgtaatacgactcactatagggagcacaaagaagccaagtcag

SEQ ID NO: 594 - DNA, 44 bp, artificial sequence
  Description of artificial sequence:  synthetic primer
gcgtaatacgactcactatagggttaagcctccaaggggtattc

SEQ ID NO: 595 - DNA, 22 bp, artificial sequence
  Description of artificial sequence:  synthetic primer
gagcacaaagaagccaagtcag

SEQ ID NO: 596 - DNA, 749 bp, Epilachna varivetis
ggtgatccttgatagtgttaagtttccaaaatttaacgaaattgtacagctcaagttatcagatggaacagttaggtctggacaagttttggaagtcagtggacagaaggcggttgtccaagtttttgaaggcacctccggaattgatgctaaaaacactttatgtgaatttacaggagatatcttaagaactccagtgtctgaagatatgttgggtcgtgtgtttaatggatctggaaagcctatcgataaagggccgccaatcttagctgaagattttcttgacattcaaggtcaacctataaatccttggtctcgtatctatccagaagaaatgatccagactggtatttctgcgattgatgtgatgaattccattgccagaggacaaaagattccaattttctctgcagctggtttaccccacaatgaaatcgctgctcaaatctgtagacaagctggtcttgtcaaaatcccagggaaatctgtcttagatgatcatgaagacaactttgctatcgttttcgccgctatgggtgtcaatatggaaacagccagattcttcaagcaagattttgaagagaatggctctatggaaaatgtgtgcctatttttgaacttggccaatgatcctaccattgaaagaattataacaccccgtttgactttaacagcggctgaatttatggcatatcaatgtgagaagcatgtgttagtcatattgactgacatgtcatcttatgctgagg

SEQ ID NO: 597 - DNA, 22 bp, artificial sequence
  Description of artificial sequence:  synthetic primer
ggtgatccttgatagtgttaag

SEQ ID NO: 598 - DNA, 42 bp, artificial sequence
  Description of artificial sequence:  synthetic primer
gcgtaatacgactcactataggcctcagcataagatgacatg

SEQ ID NO: 599 - DNA, 44 bp, artificial sequence
  Description of artificial sequence:  synthetic primer
gcgtaatacgactcactataggggtgatccttgatagtgttaag

SEQ ID NO: 600 - DNA, 20 bp, artificial sequence
  Description of artificial sequence:  synthetic primer
cctcagcataagatgacatg

SEQ ID NO: 601 - DNA, 727 bp, Anthonomus grandis
catttgaagcgttttgctgcccccaaagcatggatgttggacaaattggggggtgtgttcgcccccaggccctccaccgggccacacaagctcagggagtcccttccattagtgattttcttgcgtaacaggttgaagtacgccctgacaaactgtgaggtgaccaagatcgttatgcagagacttattaaggtcgacggcaaagtcaggactgatcctaactatcctgctggattcatggatgtgatcaccattgaaaaaactggtgaattcttccgtttgatctatgatgttaagggaagattcactattcacaggatcactgctgaagaagcaaaatacaaattgtgcaaagtccgcaaggtgcaaaccggaccaaaaggtattccattcttggtcacccacgatggtaggaccattaggtaccctgacccaatgatcaaggtaaacgacaccatccaactggaaatcgccacctcaaagatcctggactttatcaaattcgaatccggcaacttgtgcatgatcaccggaggcaggaatttgggtagagtgggaacggtagtgaacagggaaaggcatccgggatcattcgatattgtccacattagggacgctaatgatcacgtgttcgccactagattaaacaacgtattcgtcatcggtaaaggaagcaaagctttcgtgtctctgccaaggggcaagggagtgaaactgtccatcgctg

SEQ ID NO: 602 - protein, 242 aa, Anthonomus grandis
HLKRFAAPKAWMLDKLGGVFAPRPSTGPHKLRESLPLVIFLRNRLKYALTNCEVTKIVMQRLIKVDGKVRTDPNYPAGFMDVITIEKTGEFFRLIYDVKGRFTIHRITAEEAKYKLCKVRKVQTGPKGIPFLVTHDGRTIRYPDPMIKVNDTIQLEIATSKILDFIKFESGNLCMITGGRNLGRVGTVVNRERHPGSFDIVHIRDANDHVFATRLNNVFVIGKGSKAFVSLPRGKGVKLSIA

SEQ ID NO: 603 - DNA, 487 bp, Anthonomus grandis
ggtctggttggatccaaatgaaatcaatgagattgccaacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgagaaggcccgtgccaagatgttggccgaccaagctaacgccagaaggcaaaaggtgaaacaagtcccgtgagaggagggaagagcgtatcgccgcgaagaagcagga

SEQ ID NO: 604 - protein, 161 aa, Anthonomus grandis
VWLDPNEINEIANTNSRQNIRKLIKDGLIIKKPVAVHSRARVRKNTEARRKGRHCGFGKRKGTANARMPQKELWIQRMRVLRRLLKKYREAKKIDRHLYHALYMKAKGNVFKNKRVLMEYIHKKKAEKARAKMLADQANARRQKVKQVPEEGRAYRREEAG

SEQ ID NO: 605 - DNA, 904 bp, Anthonomus grandis
ctggcggccacatgcttatgggagactctttcaattcgtcgttgttcaaacaaactttccaaagggtgttcgcgaaggaccagaatggacatttgaagatggctttcaacggtactttggaggtgaagtgctctagggaattaaaagttcaaggcggtattggctcatgcgtgtcgctaaatgtaaaaagtcctttggtagcggacacggaaataggcatgggaaacaccgtgcaatggaagatgtgcaccttcaaccctagcacgacgatggcgctgtttttcgaggtggtcaatcagcattcggcccccattcctcaaggtggtagaggatgtatacagtttattacacaatatcagcactcgagtggccaaaggaggataagggtgacgacgatagcgagaaattgggcggacgcatcggcgaatattcaccacatcagcgcgggtttcgatcaggaacgtgccgcggtgattatggcccggatggctgtttatagagcggagaccgatgagagtcccgatgttttaagatgggtcgatcggatgctgattcgtttgtgtcaaaagtttggagaatataacaaagatgaccaggcatccttcagattaggagaaaattttagcttatacccgcaattcatgtaccacttaaggcgatcccagtttttgcaagtgttcaacaattcacctgacgaaacgtcgttttacaggcatatgcttatgagggaagatttgacacagtccctgataatgattcagccgatcttgtacagttacagttttaatggtcctccggagcccgttttgttggacaccagctcaatacaaccggacagaattctgcttatggacacgtttttccagatattgattttccatggagaaaccattgcccaatggcg

SEQ ID NO: 606 - protein, 300 aa, Anthonomus grandis
GGHMLMGDSFNSSLFKQTFQRVFAKDQNGHLKMAFNGTLEVKCSRELKVQGGIGSCVSLNVKSPLVADTEIGMGNTVQWKMCTFNPSTTMALFFEVVNQHSAPIPQGGRGCIQFITQYQHSSGQRRIRVTTIARNWADASANIHHISAGFDQERAAVIMARMAVYRAETDESPDVLRWVDRMLIRLCQKFGEYNKDDQASFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 607 - DNA, 644 bp, Anthonomus grandis
cgcagatcaagcatatgatggccttcattgagcaagaggctaatgaaaaggccgaggaaattgatgccaaggcggaagaagaatttaacattgaaaagggccgccttgtgcaacaacaaagattgaagatcatggaatactatgagaagaaggagaagcaagtcgaactacaaaagaaaattcaatcctccaacatgctgaaccaagcccgtcttaaggttctgaaagtccgcgaagatcatgttagagctgtattggatgaggctcgcaagaagcttggtgaagtcaccagggatcaaggcaaatatgcccagattctggaatctttgatccttcagggactctaccagcttttcgaggcaaacgtgaccgtacgcgtccgcccacaagacagaaccttagtccaatcagtgctgccaaccatcgcaaccaaataccgtgacgtcaccggccgagatgtacacctgtccatcgatgacgaaactcaactgtccgaatccgtaaccggcggaatcgaacttttgtgcaaacaaaacaaaattaaggtctgcaacaccctggaggcacgtttggacctgatttcgcaacagttggttccgcaaatccgtaacgccttgttcggacgcaacatcaaccgcaagttc

SEQ ID NO: 608 - protein, 214 aa, Anthonomus grandis
QIKHMMAFIEQEANEKAEEIDAKAEEEFNIEKGRLVQQQRLKIMEYYEKKEKQVELQKKIQSSNMLNQARLKVLKVREDHVRAVLDEARKKLGEVTRDQGKYAQILESLILQGLYQLFEANVTVRVRPQDRTLVQSVLPTIATKYRDVTGRDVHLSIDDETQLSESVTGGIELLCKQNKIKVCNTLEARLDLISQQLVPQIRNALFGRNINRKF

SEQ ID NO: 609 - DNA, 734 bp, Anthonomus grandis
gtgtcggaggatatgttgggccgagtgttcaacggatcaggaaaacccattgacaaaggtcctccaatcttagccgaagatttcttggacatccaaggtcaacccatcaacccatggtcgcgtatctacccggaagaaatgatccagaccggtatctccgccatcgacgtgatgaactccatcgcgcgtgggcaaaaaatccccattttctccgcggccggtttaccgcacaacgaaatcgccgcccaaatctgtagacaggccggtttagtcaaactgccgggcaaatcggtaatcgacgatcacgaggacaatttcgccatcgtgttcgccgccatgggtgtcaacatggaaaccgcccgtttcttcaagcaggacttcgaagaaaacggttccatggagaacgtgtgtctcttcttgaatttggccaacgatcccaccatcgagagaatcatcacgccccgtttggctctgaccgccgccgaatttttggcttatcaatgcgagaaacacgtgctggttatcttaactgatatgtcttcttacgccgaggctttgcgtgaagtatccgccgccagagaagaagtacccggacgtcgtgggttccccggttacatgtacaccgatttggccaccatttacgaaagagccggtcgcgttgagggtagaaacggttccatcacccagattcccatcttgactatgccgaacgacgacatcacccatcctattcc

SEQ ID NO: 610 - protein, 244 aa, Anthonomus grandis
VSEDMLGRVFNGSGKPIDKGPPILAEDFLDIQGQPINPWSRIYPEEMIQTGISAIDVMNSIARGQKIPIFSAAGLPHNEIAAQICRQAGLVKLPGKSVIDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 611 - DNA, 23 bp, artificial sequence
  Description of artificial sequence:  synthetic primer
catttgaagcgtttwrmygcycc

SEQ ID NO: 612 - DNA, 23 bp, artificial sequence
  Description of artificial sequence:  synthetic primer
  misc_feature (18)..(18): n is a, c, g, or t
cgcttgtcccgctcctcngcrat

SEQ ID NO: 613 - DNA, 30 bp, artificial sequence
  Description of artificial sequence:  synthetic primer
ggtctggttggatcchaatgaaatcaayga

SEQ ID NO: 614 - DNA, 26 bp, artificial sequence
  Description of artificial sequence:  synthetic primer
tcctgcttcttsgyrgcratwcgytc

SEQ ID NO: 615 - DNA, 21 bp, artificial sequence
  Description of artificial sequence:  synthetic primer
ctggcggccacatgstbatgg

SEQ ID NO: 616 - DNA, 23 bp, artificial sequence
  Description of artificial sequence:  synthetic primer
cgccattgggcratggtytckcc

SEQ ID NO: 617 - DNA, 22 bp, artificial sequence
  Description of artificial sequence:  synthetic primer
cgcagatcaarcayatgatggc

SEQ ID NO: 618 - DNA, 24 bp, artificial sequence
  Description of artificial sequence:  synthetic primer
gaacttgcggttgabgttscgdcc

SEQ ID NO: 619 - DNA, 23 bp, artificial sequence
  Description of artificial sequence:  synthetic primer
gtgtcggaggatatgytgggycg

SEQ ID NO: 620 - DNA, 24 bp, artificial sequence
  Description of artificial sequence:  synthetic primer
ggaataggatgggtratrtcgtcg

SEQ ID NO: 621 - DNA, 26 bp, Anthonomus grandis
aaaactggtgaattcttccgtttgat

SEQ ID NO: 622 - DNA, 21 bp, Anthonomus grandis
aaagcatggatgttggacaaa

SEQ ID NO: 623 - DNA, 23 bp, Anthonomus grandis
aaagcatggatgttggacaaatt

SEQ ID NO: 624 - DNA, 26 bp, Anthonomus grandis
aaagcatggatgttggacaaattggg

SEQ ID NO: 625 - DNA, 32 bp, Anthonomus grandis; identical to SEQ ID NO: 279

SEQ ID NO: 626 - DNA, 23 bp, Anthonomus grandis
aaatacaaattgtgcaaagtccg

SEQ ID NO: 627 - DNA, 22 bp, Anthonomus grandis
aacttgtgcatgatcaccggag

SEQ ID NO: 628 - DNA, 27 bp, Anthonomus grandis
aagcatggatgttggacaaattggggg

SEQ ID NO: 629 - DNA, 34 bp, Anthonomus grandis
aagcatggatgttggacaaattggggggtgtgtt

SEQ ID NO: 630 - DNA, 23 bp, Anthonomus grandis
actggtgaattcttccgtttgat

SEQ ID NO: 631 - DNA, 44 bp, Anthonomus grandis
attgaaaaaactggtgaattcttccgtttgatctatgatgttaa

SEQ ID NO: 632 - DNA, 22 bp, Anthonomus grandis
ccaaagcatggatgttggacaa

SEQ ID NO: 633 - DNA, 23 bp, Anthonomus grandis
cccaaagcatggatgttggacaa

SEQ ID NO: 634 - DNA, 24 bp, Anthonomus grandis
cccaaagcatggatgttggacaaa

SEQ ID NO: 635 - DNA, 26 bp, Anthonomus grandis
cccaaagcatggatgttggacaaatt

SEQ ID NO: 636 - DNA, 29 bp, Anthonomus grandis
cccaaagcatggatgttggacaaattggg

SEQ ID NO: 637 - DNA, 31 bp, Anthonomus grandis
cccaaagcatggatgttggacaaattggggg

SEQ ID NO: 638 - DNA, 35 bp, Anthonomus grandis; identical to SEQ ID NO: 291

SEQ ID NO: 639 - DNA, 38 bp, Anthonomus grandis
cccaaagcatggatgttggacaaattggggggtgtgtt

SEQ ID NO: 640 - DNA, 21 bp, Anthonomus grandis
ctggattcatggatgtgatca

SEQ ID NO: 641 - DNA, 26 bp, Anthonomus grandis
gaattcttccgtttgatctatgatgt

SEQ ID NO: 642 - DNA, 23 bp, Anthonomus grandis
gcatggatgttggacaaattggg

SEQ ID NO: 643 - DNA, 25 bp, Anthonomus grandis
gcatggatgttggacaaattggggg

SEQ ID NO: 644 - DNA, 29 bp, Anthonomus grandis
gcatggatgttggacaaattggggggtgt

SEQ ID NO: 645 - DNA, 38 bp, Anthonomus grandis
gcatggatgttggacaaattggggggtgtgttcgcccc

SEQ ID NO: 646 - DNA, 26 bp, Anthonomus grandis
gcccccaaagcatggatgttggacaa

SEQ ID NO: 647 - DNA, 21 bp, Anthonomus grandis
gctggattcatggatgtgatc

SEQ ID NO: 648 - DNA, 23 bp, Anthonomus grandis
ggatcattcgatattgtccacat

SEQ ID NO: 649 - DNA, 26 bp, Anthonomus grandis
ggcaacttgtgcatgatcaccggagg

SEQ ID NO: 650 - DNA, 23 bp, Anthonomus grandis
tacaaattgtgcaaagtccgcaa

SEQ ID NO: 651 - DNA, 23 bp, Anthonomus grandis
tatcctgctggattcatggatgt

SEQ ID NO: 652 - DNA, 29 bp, Anthonomus grandis
tcaccattgaaaaaactggtgaattcttc

SEQ ID NO: 653 - DNA, 23 bp, Anthonomus grandis
tgcatgatcaccggaggcaggaa

SEQ ID NO: 654 - DNA, 29 bp, Anthonomus grandis
tgcatgatcaccggaggcaggaatttggg

SEQ ID NO: 655 - DNA, 26 bp, Anthonomus grandis
tggatgttggacaaattggggggtgt

SEQ ID NO: 656 - DNA, 22 bp, Anthonomus grandis
tgtgcatgatcaccggaggcag

SEQ ID NO: 657 - DNA, 31 bp, Anthonomus grandis
tgtgcatgatcaccggaggcaggaatttggg

SEQ ID NO: 658 - DNA, 25 bp, Anthonomus grandis
aagatcgacaggcatctgtaccacg

SEQ ID NO: 659 - DNA, 41 bp, Anthonomus grandis
aagatcgacaggcatctgtaccacgccctgtacatgaaggc

SEQ ID NO: 660 - DNA, 23 bp, Anthonomus grandis
aagggtaacgtgttcaagaacaa

SEQ ID NO: 661 - DNA, 24 bp, Anthonomus grandis
aagggtaacgtgttcaagaacaag

SEQ ID NO: 662 - DNA, 29 bp, Anthonomus grandis
aagggtaacgtgttcaagaacaagagagt

SEQ ID NO: 663 - DNA, 22 bp, Anthonomus grandis
acaagaagaaggctgagaaggc

SEQ ID NO: 664 - DNA, 23 bp, Anthonomus grandis
atcaaggatggtttgatcattaa

SEQ ID NO: 665 - DNA, 24 bp, Anthonomus grandis
atggaatacatccacaagaagaag

SEQ ID NO: 666 - DNA, 30 bp, Anthonomus grandis
caaaacatccgtaaattgatcaaggatggt

SEQ ID NO: 667 - DNA, 38 bp, Anthonomus grandis
caaaacatccgtaaattgatcaaggatggtttgatcat

SEQ ID NO: 668 - DNA, 21 bp, Anthonomus grandis
caagggtaacgtgttcaagaa

SEQ ID NO: 669 - DNA, 25 bp, Anthonomus grandis
caagggtaacgtgttcaagaacaag

SEQ ID NO: 670 - DNA, 29 bp, Anthonomus grandis
catctgtaccacgccctgtacatgaaggc

SEQ ID NO: 671 - DNA, 21 bp, Anthonomus grandis
gaagaaggctgagaaggcccg

SEQ ID NO: 672 - DNA, 35 bp, Anthonomus grandis
gacaggcatctgtaccacgccctgtacatgaaggc

SEQ ID NO: 673 - DNA, 24 bp, Anthonomus grandis
gagaaggcccgtgccaagatgttg

SEQ ID NO: 674 - DNA, 26 bp, Anthonomus grandis
gatccaaatgaaatcaatgagattgc

SEQ ID NO: 675 - DNA, 27 bp, Anthonomus grandis
gctcgtatgcctcaaaaggaactatgg

SEQ ID NO: 676 - DNA, 22 bp, Anthonomus grandis
gggtaacgtgttcaagaacaag

SEQ ID NO: 677 - DNA, 21 bp, Anthonomus grandis
ggtaacgtgttcaagaacaag

SEQ ID NO: 678 - DNA, 27 bp, Anthonomus grandis
tacatccacaagaagaaggctgagaag

SEQ ID NO: 679 - DNA, 23 bp, Anthonomus grandis
taccacgccctgtacatgaaggc

SEQ ID NO: 680 - DNA, 25 bp, Anthonomus grandis
tcaatgagattgccaacaccaactc

SEQ ID NO: 681 - DNA, 22 bp, Anthonomus grandis
tgatcaaggatggtttgatcat

SEQ ID NO: 682 - DNA, 28 bp, Anthonomus grandis
tgatcaaggatggtttgatcattaagaa

SEQ ID NO: 683 - DNA, 22 bp, Anthonomus grandis
tggttggatccaaatgaaatca

SEQ ID NO: 684 - DNA, 23 bp, Anthonomus grandis
tggttggatccaaatgaaatcaa

SEQ ID NO: 685 - DNA, 29 bp, Anthonomus grandis
tggttggatccaaatgaaatcaatgagat

SEQ ID NO: 686 - DNA, 25 bp, Anthonomus grandis
tgtaccacgccctgtacatgaaggc

SEQ ID NO: 687 - DNA, 22 bp, Anthonomus grandis
ttgatcaaggatggtttgatca

SEQ ID NO: 688 - DNA, 23 bp, Anthonomus grandis
ttgatcaaggatggtttgatcat

SEQ ID NO: 689 - DNA, 29 bp, Anthonomus grandis
ttgatggaatacatccacaagaagaaggc

SEQ ID NO: 690 - DNA, 23 bp, Anthonomus grandis
aggatgcgtgtcttgaggcgtct

SEQ ID NO: 691 - DNA, 30 bp, Anthonomus grandis
aaggccaagggtaacgtgttcaagaacaag

SEQ ID NO: 692 - DNA, 26 bp, Anthonomus grandis
cgtttgtgtcaaaagtttggagaata

SEQ ID NO: 693 - DNA, 23 bp, Anthonomus grandis
gatgttttaagatgggtcgatcg

SEQ ID NO: 694 - DNA, 32 bp, Anthonomus grandis
ttttacaggcatatgcttatgagggaagattt

SEQ ID NO: 695 - DNA, 29 bp, Anthonomus grandis
tttttcgaggtggtcaatcagcattcggc

SEQ ID NO: 696 - DNA, 21 bp, Anthonomus grandis
aacatgctgaaccaagcccgt

SEQ ID NO: 697 - DNA, 23 bp, Anthonomus grandis
aacatgctgaaccaagcccgtct

SEQ ID NO: 698 - DNA, 26 bp, Anthonomus grandis
aagatcatggaatactatgagaagaa

SEQ ID NO: 699 - DNA, 32 bp, Anthonomus grandis
aagatcatggaatactatgagaagaaggagaa

SEQ ID NO: 700 - DNA, 26 bp, Anthonomus grandis
aatgaaaaggccgaggaaattgatgc

SEQ ID NO: 701 - DNA, 23 bp, Anthonomus grandis
atggaatactatgagaagaagga

SEQ ID NO: 702 - DNA, 23 bp, Anthonomus grandis
caatcctccaacatgctgaacca

SEQ ID NO: 703 - DNA, 26 bp, Anthonomus grandis
cagatcaagcatatgatggccttcat

SEQ ID NO: 704 - DNA, 27 bp, Anthonomus grandis
gcagatcaagcatatgatggccttcat

SEQ ID NO: 705 - DNA, 29 bp, Anthonomus grandis
gcggaagaagaatttaacattgaaaaggg

SEQ ID NO: 706 - DNA, 25 bp, Anthonomus grandis
aacgacgacatcacccatcctattc

SEQ ID NO: 707 - DNA, 23 bp, Anthonomus grandis
aacggttccatggagaacgtgtg

SEQ ID NO: 708 - DNA, 26 bp, Anthonomus grandis
aacggttccatggagaacgtgtgtct

SEQ ID NO: 709 - DNA, 35 bp, Anthonomus grandis
aacggttccatggagaacgtgtgtctcttcttgaa

SEQ ID NO: 710 - DNA, 23 bp, Anthonomus grandis
atgatccagaccggtatctccgc

SEQ ID NO: 711 - DNA, 26 bp, Anthonomus grandis
atgccgaacgacgacatcacccatcc

SEQ ID NO: 712 - DNA, 23 bp, Anthonomus grandis
caatgcgagaaacacgtgctggt

SEQ ID NO: 713 - DNA, 26 bp, Anthonomus grandis
ccgcacaacgaaatcgccgcccaaat

SEQ ID NO: 714 - DNA, 23 bp, Anthonomus grandis
cgtttcttcaagcaggacttcga

SEQ ID NO: 715 - DNA, 36 bp, Anthonomus grandis
cttggacatccaaggtcaacccatcaacccatggtc

SEQ ID NO: 716 - DNA, 23 bp, Anthonomus grandis
gaaatgatccagaccggtatctc

SEQ ID NO: 717 - DNA, 44 bp, Anthonomus grandis
gaaatgatccagaccggtatctccgccatcgacgtgatgaactc

SEQ ID NO: 718 - DNA, 23 bp, Anthonomus grandis
gaagaaatgatccagaccggtat

SEQ ID NO: 719 - DNA, 23 bp, Anthonomus grandis
gaagaagtacccggacgtcgtgg

SEQ ID NO: 720 - DNA, 23 bp, Anthonomus grandis
gacatccaaggtcaacccatcaa

SEQ ID NO: 721 - DNA, 26 bp, Anthonomus grandis
gcccgtttcttcaagcaggacttcga

SEQ ID NO: 722 - DNA, 23 bp, Anthonomus grandis
gccgcccaaatctgtagacaggc

SEQ ID NO: 723 - DNA, 29 bp, Anthonomus grandis
ggatcaggaaaacccattgacaaaggtcc

SEQ ID NO: 724 - DNA, 23 bp, Anthonomus grandis
ggttacatgtacaccgatttggc

SEQ ID NO: 725 - DNA, 29 bp, Anthonomus grandis
ggttacatgtacaccgatttggccaccat

SEQ ID NO: 726 - DNA, 36 bp, Anthonomus grandis
ggttacatgtacaccgatttggccaccatttacgaa

SEQ ID NO: 727 - DNA, 23 bp, Anthonomus grandis
gtgtcggaggatatgttgggccg

SEQ ID NO: 728 - DNA, 26 bp, Anthonomus grandis
tacatgtacaccgatttggccaccat

SEQ ID NO: 729 - DNA, 35 bp, Anthonomus grandis
ttcaacggatcaggaaaacccattgacaaaggtcc

SEQ ID NO: 730 - DNA, 32 bp, Anthonomus grandis
ttccccggttacatgtacaccgatttggccac

SEQ ID NO: 731 - DNA, 35 bp, Anthonomus grandis
ttccccggttacatgtacaccgatttggccaccat

SEQ ID NO: 732 - DNA, 38 bp, Anthonomus grandis
ttccccggttacatgtacaccgatttggccaccattta

SEQ ID NO: 733 - DNA, 41 bp, Anthonomus grandis
ttccccggttacatgtacaccgatttggccaccatttacga

SEQ ID NO: 734 - DNA, 29 bp, Anthonomus grandis
ttcgccatcgtgttcgccgccatgggtgt

SEQ ID NO: 735 - DNA, 23 bp, Anthonomus grandis
ttcttcaagcaggacttcgaaga

SEQ ID NO: 736 - DNA, 23 bp, Anthonomus grandis
ttcttgaatttggccaacgatcc

SEQ ID NO: 737 - DNA, 33 bp, Anthonomus grandis
ttcttgaatttggccaacgatcccaccatcgag

SEQ ID NO: 738 - DNA, 23 bp, Anthonomus grandis
gccgaatttttggcttatcaatg

SEQ ID NO: 739 - DNA, 22 bp, Anthonomus grandis
gctggattcatggatgtgatca

SEQ ID NO: 740 - DNA, 21 bp, Anthonomus grandis
atggatgttggacaaattggg

SEQ ID NO: 741 - DNA, 23 bp, Anthonomus grandis
ttcatggatgtgatcaccattga

SEQ ID NO: 742 - DNA, 29 bp, Anthonomus grandis
gtctggttggatccaaatgaaatcaatga

SEQ ID NO: 743 - DNA, 21 bp, Anthonomus grandis
ggatccaaatgaaatcaatga

SEQ ID NO: 744 - DNA, 22 bp, Anthonomus grandis
tgatcaaggatggtttgatcat

SEQ ID NO: 745 - DNA, 26 bp, Anthonomus grandis
tggttggatccaaatgaaatcaatga

SEQ ID NO: 746 - DNA, 26 bp, Anthonomus grandis
ccaagggtaacgtgttcaagaacaag

SEQ ID NO: 747 - DNA, 26 bp, Anthonomus grandis
tggttggatccaaatgaaatcaatga

SEQ ID NO: 748 - DNA, 22 bp, Anthonomus grandis
tggatccaaatgaaatcaatga

SEQ ID NO: 749 - DNA, 23 bp, Anthonomus grandis
gaagaatttaacattgaaaaggg

SEQ ID NO: 750 - DNA, 23 bp, Anthonomus grandis
gaatttaacattgaaaagggccg

SEQ ID NO: 751 - DNA, 23 bp, Anthonomus grandis
ggttacatgtacaccgatttggc

SEQ ID NO: 752 - DNA, 23 bp, Anthonomus grandis
cgtaacaggttgaagtacgccct

SEQ ID NO: 753 - DNA, 27 bp, Anthonomus grandis
aaggtcgacggcaaagtcaggactgat

SEQ ID NO: 754 - DNA, 22 bp, Anthonomus grandis
ccattcttggtcacccacgatg

SEQ ID NO: 755 - DNA, 21 bp, Anthonomus grandis
atcaaggtaaacgacaccatc

SEQ ID NO: 756 - DNA, 38 bp, Anthonomus grandis
tgtacatgaaggccaagggtaacgtgttcaagaacaag

SEQ ID NO: 757 - DNA, 26 bp, Anthonomus grandis
ccaagggtaacgtgttcaagaacaag

SEQ ID NO: 758 - DNA, 24 bp, Anthonomus grandis
aagggtaacgtgttcaagaacaag

SEQ ID NO: 759 - DNA, 21 bp, Anthonomus grandis
caagaagaaggctgagaaggc

SEQ ID NO: 760 - DNA, 21 bp, Anthonomus grandis
caagaagaaggctgagaaggc

SEQ ID NO: 761 - DNA, 21 bp, Anthonomus grandis
aagaagaaggctgagaaggcc

SEQ ID NO: 762 - DNA, 32 bp, Anthonomus grandis
caaaacatccgtaaattgatcaaggatggttt

SEQ ID NO: 763 - DNA, 21 bp, Anthonomus grandis
ttcgccgccatgggtgtcaac

SEQ ID NO: 764 - DNA, 23 bp, Anthonomus grandis
atgggtgtcaacatggaaaccgc

SEQ ID NO: 765 - DNA, 21 bp, Anthonomus grandis
tggaaaccgcccgtttcttca

SEQ ID NO: 766 - DNA, 21 bp, Anthonomus grandis
ggttacatgtacaccgatttg

SEQ ID NO: 767 - DNA, 26 bp, Anthonomus grandis
gtcaagatgggaatctgggtgatgga

SEQ ID NO: 768 - DNA, 444 bp, Anthonomus grandis
gcatggatgttggacaaattggggggtgtgttcgcccccaggccctccaccgggccacacaagctcagggagtcccttccattagtgattttcttgcgtaacaggttgaagtacgccctgacaaactgtgaggtgaccaagatcgttatgcagagacttattaaggtcgacggcaaagtcaggactgatcctaactatcctgctggattcatggatgtgatcaccattgaaaaaactggtgaattcttccgtttgatctatgatgttaagggaagattcactattcacaggatcactgctgaagaagcaaaatacaaattgtgcaaagtccgcaaggtgcaaaccggaccaaaaggtattccattcttggtcacccacgatggtaggaccattaggtaccctgacccaatgatcaaggtaaacgacaccatccaactggaaatc

SEQ ID NO: 769 - DNA, 44 bp, artificial sequence
  Description of artificial sequence:  synthetic primer
gcgtaatacgactcactatagggcatggatgttggacaaattgg

SEQ ID NO: 770 - DNA, 22 bp, artificial sequence
  Description of artificial sequence:  synthetic primer
gatttccagttggatggtgtcg

SEQ ID NO: 771 - DNA, 22 bp, artificial sequence
  Description of artificial sequence:  synthetic primer
gcatggatgttggacaaattgg

SEQ ID NO: 772 - DNA, 44 bp, artificial sequence
  Description of artificial sequence:  synthetic primer
gcgtaatacgactcactatagggatttccagttggatggtgtcg

SEQ ID NO: 773 - DNA, 398 bp, Anthonomus grandis
caacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgagaaggcccgtgccaagatgttggccgaccaagctaacgccagaaggcaaaagg

SEQ ID NO: 774 - DNA, 44 bp, artificial sequence
  Description of artificial sequence:  synthetic primer
gcgtaatacgactcactataggcaacaccaactcgaggcaaaac

SEQ ID NO: 775 - DNA, 21 bp, artificial sequence
  Description of artificial sequence:  synthetic primer
ccttttgccttctggcgttag

SEQ ID NO: 776 - DNA, 22 bp, artificial sequence
  Description of artificial sequence:  synthetic primer
caacaccaactcgaggcaaaac

SEQ ID NO: 777 - DNA, 43 bp, artificial sequence
  Description of artificial sequence:  synthetic primer
gcgtaatacgactcactataggccttttgccttctggcgttag

SEQ ID NO: 778 - DNA, 555 bp, Anthonomus grandis
caaactttccaaagggtgttcgcgaaggaccagaatggacatttgaagatggctttcaacggtactttggaggtgaagtgctctagggaattaaaagttcaaggcggtattggctcatgcgtgtcgctaaatgtaaaaagtcctttggtagcggacacggaaataggcatgggaaacaccgtgcaatggaagatgtgcaccttcaaccctagcacgacgatggcgctgtttttcgaggtggtcaatcagcattcggcccccattcctcaaggtggtagaggatgtatacagtttattacacaatatcagcactcgagtggccaaaggaggataagggtgacgacgatagcgagaaattgggcggacgcatcggcgaatattcaccacatcagcgcgggtttcgatcaggaacgtgccgcggtgattatggcccggatggctgtttatagagcggagaccgatgagagtcccgatgttttaagatgggtcgatcggatgctgattcgtttgtgtcaaaagtttggagaatataacaaagatgaccaggcatccttc

SEQ ID NO: 779 - DNA, 44 bp, artificial sequence
  Description of artificial sequence:  synthetic primer
gcgtaatacgactcactataggcaaactttccaaagggtgttcg

SEQ ID NO: 780 - DNA, 22 bp, artificial sequence
  Description of artificial sequence:  synthetic primer
gaaggatgcctggtcatctttg

SEQ ID NO: 781 - DNA, 22 bp, artificial sequence
  Description of artificial sequence:  synthetic primer
caaactttccaaagggtgttcg

SEQ ID NO: 782 - DNA, 44 bp, artificial sequence
  Description of artificial sequence:  synthetic primer
gcgtaatacgactcactatagggaaggatgcctggtcatctttg

SEQ ID NO: 783 - DNA, 549 bp, Anthonomus grandis
gaaaaggccgaggaaattgatgccaaggcggaagaagaatttaacattgaaaagggccgccttgtgcaacaacaaagattgaagatcatggaatactatgagaagaaggagaagcaagtcgaactacaaaagaaaattcaatcctccaacatgctgaaccaagcccgtcttaaggttctgaaagtccgcgaagatcatgttagagctgtattggatgaggctcgcaagaagcttggtgaagtcaccagggatcaaggcaaatatgcccagattctggaatctttgatccttcagggactctaccagcttttcgaggcaaacgtgaccgtacgcgtccgcccacaagacagaaccttagtccaatcagtgctgccaaccatcgcaaccaaataccgtgacgtcaccggccgagatgtacacctgtccatcgatgacgaaactcaactgtccgaatccgtaaccggcggaatcgaacttttgtgcaaacaaaacaaaattaaggtctgcaacaccctggaggcacgtttggacctgatttcgcaacagttg

SEQ ID NO: 784 - DNA, 44 bp, artificial sequence
  Description of artificial sequence:  synthetic primer
gcgtaatacgactcactatagggaaaaggccgaggaaattgatg

SEQ ID NO: 785 - DNA, 22 bp, artificial sequence
  Description of artificial sequence:  synthetic primer
caactgttgcgaaatcaggtcc

SEQ ID NO: 786 - DNA, 22 bp, artificial sequence
  Description of artificial sequence:  synthetic primer
gaaaaggccgaggaaattgatg

SEQ ID NO: 787 - DNA, 44 bp, artificial sequence
  Description of artificial sequence:  synthetic primer
gcgtaatacgactcactataggcaactgttgcgaaatcaggtcc

SEQ ID NO: 788 - DNA, 632 bp, Anthonomus grandis
gtgttcaacggatcaggaaaacccattgacaaaggtcctccaatcttagccgaagatttcttggacatccaaggtcaacccatcaacccatggtcgcgtatctacccggaagaaatgatccagaccggtatctccgccatcgacgtgatgaactccatcgcgcgtgggcaaaaaatccccattttctccgcggccggtttaccgcacaacgaaatcgccgcccaaatctgtagacaggccggtttagtcaaactgccgggcaaatcggtaatcgacgatcacgaggacaatttcgccatcgtgttcgccgccatgggtgtcaacatggaaaccgcccgtttcttcaagcaggacttcgaagaaaacggttccatggagaacgtgtgtctcttcttgaatttggccaacgatcccaccatcgagagaatcatcacgccccgtttggctctgaccgccgccgaatttttggcttatcaatgcgagaaacacgtgctggttatcttaactgatatgtcttcttacgccgaggctttgcgtgaagtatccgccgccagagaagaagtacccggacgtcgtgggttccccggttacatgtacaccgatttggccaccatttacgaaagagccggtcg

SEQ ID NO: 789 - DNA, 45 bp, artificial sequence
  Description of artificial sequence:  synthetic primer
gcgtaatacgactcactatagggtgttcaacggatcaggaaaacc

SEQ ID NO: 790 - DNA, 21 bp, artificial sequence
  Description of artificial sequence:  synthetic primer
cgaccggctctttcgtaaatg

SEQ ID NO: 791 - DNA, 23 bp, artificial sequence
  Description of artificial sequence:  synthetic primer
gtgttcaacggatcaggaaaacc

SEQ ID NO: 792 - DNA, 43 bp, artificial sequence
  Description of artificial sequence:  synthetic primer
gcgtaatacgactcactataggcgaccggctctttcgtaaatg

SEQ ID NO: 793 - DNA, 642 bp, Tribolium castaneum
ggccccaagaagcatttgaagcgtctcaatgcgcccaaagcatggatgttggataaactggggggtgtgtttgcccctcggccttccaccggcccccacaagctacgggagtcgctacctttggttatcttcctgcgaaacaggctgaagtatgccttgaccaactcagaagtgacgaagattgttatgcaaagattgattaaagttgacggaaaagttaggacagaccccaactaccccgcgggtttcatggatgttgtgactattgagaaaactggggaattcttccgcttgatttatgatgttaagggaaggttcacaatccatcgcattactggagaagaggccaaatataaattgtgcaaagtgaagaaagtacagacaggccccaagggcattcccttcttggtgacccgcgacggacgcactatcagatacccagaccccatgatcaaagtgaatgacaccattcaattggagattgccacttcgaaaattcttgattttatcaaatttgagtccggtaatttgtgtatgattactggaggtcgtaacttggggcgtgtcggtacagtggtgagccgagaacgtcacccaggttccttcgacatcgttcatattaaggatgcaaatgggcacacc

SEQ ID NO: 794 - protein, 245 aa, Tribolium castaneum
GPKKHLKRLNAPKAWMLDKLGGVFAPRPSTGPHKLRESLPLVIFLRNRLKYALTNSEVTKIVMQRLIKVDGKVRTDPNYPAGFMDVVTIEKTGEFFRLIYDVKGRFTIHRITGEEAKYKLCKVKKVQTGPKGIPFLVTRDGRTIRYPDPMIKVNDTIQLEIATSKILDFIKFESGNLCMITGGRNLGRVGTVVSRERHPGSFDIVHIKDANGHTFATRLNNVFIIGKGSKPYVSLPRGKGVKLSI

SEQ ID NO: 795 - DNA, 290 bp, Tribolium castaneum
caggagttcctggaggctaaaatcgaccaagagatcctcacagcgaagaaaaacgcgtcgaaaaacaaacgagcggccatccaggccatcaagaggaagaaacgctacgaaaagcagctccagcagatcgatggcaccctcagcaccatcgagatgcagcgggaggccctcgagggggccaacaccaacacagccgtactcaaaacgatgaaaaacgcagcggacgccctcaaaaatgcccacctcaacatggatgttgatgaggtacatgacatgatggatgacattgc

SEQ ID NO: 796 - protein, 96 aa, Tribolium castaneum
QEFLEAKIDQEILTAKKNASKNKRAAIQAIKRKKRYEKQLQQIDGTLSTIEMQREALEGANTNTAVLKTMKNAADALKNAHLNMDVDEVHDMMDDI

SEQ ID NO: 797 - DNA, 384 bp, Tribolium castaneum
aaaattcggcgaatacaacaaagacgaccctaacagtttccgtttgagtgaaaacttcagtctctatccccaattcatgtaccatttgcgccgctcccaattcctccaagttttcaacaactccccagacgagacctcgttctaccgccacatgctgatgcgggaggacctcacccaaagtctcattatgatccagccgattttgtacagttatagtttcaacggcccccctgaacccgtcctcctcgacactagttccattcaacccgatcggatccttctcatggacacatttttccaaattttgattttccacggtgagacaatcgcccaatggaggaacctcaagtaccaggacatgcccgaatacgagaacttccggca

SEQ ID NO: 798 - protein, 127 aa, Tribolium castaneum
PEVLVFGHVLVLEVPPLGDCLTVENQNLEKCVHEKDPIGLNGTSVEEDGFRGAVETITVQNRLDHNETLGEVLPHQHVAVERGLVWGVVENLEELGAAQMVHELGIETEVFTQTETVRVVFVVFAEF

SEQ ID NO: 799 - DNA, 621 bp, Tribolium castaneum
gagaaagccgaagaaatcgatgcgaaagctgaggaggagtttaacattgaaaaagggcgcctggtccaacaacagcgcttgaagatcatggaatattacgagaagaaggagaaaccggtggaattgcagaagaaaattcagtcgtcaaacatgctgaaccaagcccgtttgaaagtattaaaagtgcgtgaagaccacgtccacaatgtgctggatgacgcccgcaaacgtctgggcgaaatcaccaatgaccaggcgagatattcacaacttttggagtctcttatcctccagagtctctaccagtacttgggaatcagtgatgagttgtttgagaacaatatagtggtgagagtcaggcaacaggacaggagtataatccagggcattctcccagttgttgcgacgaaatacagggacgccactggtaaagacgttcatcttaaaatcgacgatgagagccacttgccatccgaaaccaccggaggagtggttttgtatgcgcaaaagggtaaaatcaagattgacaacaccttggaggctcgtttggatttaattgcacagcaacttgtgccagaaattcgtacggccttgtttggacgcaacatcaaccgcaagttc

SEQ ID NO: 800 - protein, 207 aa, Tribolium castaneum
EKAEEIDAKAEEEFNIEKGRLVQQQRLKIMEYYEKKEKPVELQKKIQSSNMLNQARLKVLKVREDHVHNVLDDARKRLGEITNDQARYSQLLESLILQSLYQYLGISDELFENNIVVRVRQQDRSIIQGILPVVATKYRDATGKDVHLKIDDESHLPSETTGGVVLYAQKGKIKIDNTLEARLDLIAQQLVPEIRTALFGRNINRKF

SEQ ID NO: 801 - DNA, 957 bp, Tribolium castaneum
ggatgaactacagctgttccgtggcgatacagtgttgctgaaagggaagcggcggaaagagaccgtctgcattgtgctggccgacgaaaactgccccgatgagaagatccggatgaacaggatcgtcaggaataatctacgggttaggctctctgacgtcgtctggatccagccctgtcccgacgtcaaatacgggaagaggatccacgttttgcccatcgatgacacggtcgaagggctcgtcggaaatctcttcgaggtgtacttaaaaccatacttcctcgaagcttatcgaccaatccacaaaggcgacgttttcatcgtccgtggtggcatgcgagccgttgaattcaaagtggtggaaacggaaccgtcaccatattgtatcgtcgcccccgataccgtcatccattgtgacggcgatccgatcaaacgagaagaagaggaggaagccttgaacgccgtcggctacgacgatatcggcggttgtcgcaaacaactcgcacaaatcaaagaaatggtcgaattacctctacgccacccgtcgctcttcaaggccattggcgtgaaaccaccacgtggtatcctcttgtacggacctccaggtaccggtaaaactttaatcgcacgtgcagtggccaacgaaaccggtgctttcttcttcttaatcaacggtcccgaaattatgagtaaattagccggcgaatccgaaagtaatctaaggaaagcgttcgaagaagccgataaaaactcaccggctattattttcatcgatgaattggacgcgattgcaccgaaacgtgaaaaaacccacggcgaagtcgaacgccgaattgtctcgcaattgttaacactgatggacggcatgaagaaaagctcgcatgttatcgtgatggcggccacaaatcgcccgaactcaatcgatccggctttgcgtcggttcggtcgctttgatcg

SEQ ID NO: 802 - protein, 318 aa, Tribolium castaneum
DELQLFRGDTVLLKGKRRKETVCIVLADENCPDEKIRMNRIVRNNLRVRLSDVVWIQPCPDVKYGKRIHVLPIDDTVEGLVGNLFEVYLKPYFLEAYRPIHKGDVFIVRGGMRAVEFKVVETEPSPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFD

SEQ ID NO: 803 - DNA, 23 bp, artificial sequence
  Description of artificial sequence:  synthetic primer
ggccccaagaagcatttgaagcg

SEQ ID NO: 804 - DNA, 23 bp, artificial sequence
  Description of artificial sequence:  synthetic primer
  misc_feature (18)..(18): n is a, c, g, or t
cgcttgtcccgctcctcngcrat

SEQ ID NO: 805 - DNA, 26 bp, artificial sequence
  Description of artificial sequence:  synthetic primer
caggagttcctggarrmbaaratmga

SEQ ID NO: 806 - DNA, 26 bp, artificial sequence
  Description of artificial sequence:  synthetic primer
gcaatgtcatccatcakrtcrtgtac

SEQ ID NO: 807 - DNA, 22 bp, artificial sequence
  Description of artificial sequence:  synthetic primer
gcattctgcgctgggtcgatcg

SEQ ID NO: 808 - DNA, 22 bp, artificial sequence
  Description of artificial sequence:  synthetic primer
gcattctgcgctgggtcgatcg

SEQ ID NO: 809 - DNA, 23 bp, artificial sequence
  Description of artificial sequence:  synthetic primer
gagaaagccgargaratygatgc

SEQ ID NO: 810 - DNA, 24 bp, artificial sequence
  Description of artificial sequence:  synthetic primer
gaacttgcggttgabgttscgdcc

SEQ ID NO: 811 - DNA, 24 bp, artificial sequence
  Description of artificial sequence:  synthetic primer
ggatgaactacagctbttccghgg

SEQ ID NO: 812 - DNA, 23 bp, artificial sequence
  Description of artificial sequence:  synthetic primer
cgatcaaagcgwccraavcgacg

SEQ ID NO: 813 - DNA, 21 bp, Tribolium castaneum
aaagcatggatgttggataaa

SEQ ID NO: 814 - DNA, 23 bp, Tribolium castaneum
aatttgtgtatgattactggagg

SEQ ID NO: 815 - DNA, 26 bp, Tribolium castaneum
actggaggtcgtaacttggggcgtgt

SEQ ID NO: 816 - DNA, 32 bp, Tribolium castaneum
atgattactggaggtcgtaacttggggcgtgt

SEQ ID NO: 817 - DNA, 26 bp, Tribolium castaneum
atgcaaagattgattaaagttgacgg

SEQ ID NO: 818 - DNA, 21 bp, Tribolium castaneum
attaaagttgacggaaaagtt

SEQ ID NO: 819 - DNA, 26 bp, Tribolium castaneum
attgagaaaactggggaattcttccg

SEQ ID NO: 820 - DNA, 38 bp, Tribolium castaneum
attgttatgcaaagattgattaaagttgacggaaaagt

SEQ ID NO: 821 - DNA, 22 bp, Tribolium castaneum
ccaagaagcatttgaagcgtct

SEQ ID NO: 822 - DNA, 23 bp, Tribolium castaneum
ccaagaagcatttgaagcgtctc

SEQ ID NO: 823 - DNA, 23 bp, Tribolium castaneum
gcgcccaaagcatggatgttgga

SEQ ID NO: 824 - DNA, 24 bp, Tribolium castaneum
ggccccaagaagcatttgaagcgt

SEQ ID NO: 825 - DNA, 31 bp, Tribolium castaneum
tgattactggaggtcgtaacttggggcgtgt

SEQ ID NO: 826 - DNA, 35 bp, Tribolium castaneum
tgtatgattactggaggtcgtaacttggggcgtgt

SEQ ID NO: 827 - DNA, 21 bp, Tribolium castaneum
ttgatttatgatgttaaggga

SEQ ID NO: 828 - DNA, 26 bp, Tribolium castaneum
ttgtgtatgattactggaggtcgtaa

SEQ ID NO: 829 - DNA, 26 bp, Tribolium castaneum
aaaaacaaacgagcggccatccaggc

SEQ ID NO: 830 - DNA, 66 bp, Tribolium castaneum
atcgaccaagagatcctcacagcgaagaaaaacgcgtcgaaaaacaaacgagcggccatccaggcc

SEQ ID NO: 831 - DNA, 23 bp, Tribolium castaneum
ctccagcagatcgatggcaccct

SEQ ID NO: 832 - DNA, 178 bp, Tribolium castaneum
tcaagaggaagaaacgctacgaaaagcagctccagcagatcgatggcaccctcagcaccatcgagatgcagcgggaggccctcgagggggccaacaccaacacagccgtactcaaaacgatgaaaaacgcagcggacgccctcaaaaatgcccacctcaacatggatgttgatgaggt

SEQ ID NO: 833 - DNA, 26 bp, Tribolium castaneum
aacctcaagtaccaggacatgcccga

SEQ ID NO: 834 - DNA, 21 bp, Tribolium castaneum
agccgattttgtacagttata

SEQ ID NO: 835 - DNA, 21 bp, Tribolium castaneum
atggacacatttttccaaatt

SEQ ID NO: 836 - DNA, 35 bp, Tribolium castaneum
atggacacatttttccaaattttgattttccacgg

SEQ ID NO: 837 - DNA, 21 bp, Tribolium castaneum
caagtaccaggacatgcccga

SEQ ID NO: 838 - DNA, 24 bp, Tribolium castaneum
cacatgctgatgcgggaggacctc

SEQ ID NO: 839 - DNA, 24 bp, Tribolium castaneum
cctcaagtaccaggacatgcccga

SEQ ID NO: 840 - DNA, 22 bp, Tribolium castaneum
tcaagtaccaggacatgcccga

SEQ ID NO: 841 - DNA, 23 bp, Tribolium castaneum
ttcatgtaccatttgcgccgctc

SEQ ID NO: 842 - DNA, 26 bp, Tribolium castaneum
aaaattcagtcgtcaaacatgctgaa

SEQ ID NO: 843 - DNA, 21 bp, Tribolium castaneum
aacatgctgaaccaagcccgt

SEQ ID NO: 844 - DNA, 22 bp, Tribolium castaneum
cacagcaacttgtgccagaaat

SEQ ID NO: 845 - DNA, 23 bp, Tribolium castaneum
gagaaagccgaagaaatcgatgc

SEQ ID NO: 846 - DNA, 21 bp, Tribolium castaneum
gcccgcaaacgtctgggcgaa

SEQ ID NO: 847 - DNA, 22 bp, Tribolium castaneum
taaaagtgcgtgaagaccacgt

SEQ ID NO: 848 - DNA, 23 bp, Tribolium castaneum
acactgatggacggcatgaagaa

SEQ ID NO: 849 - DNA, 23 bp, Tribolium castaneum
atcggcggttgtcgcaaacaact

SEQ ID NO: 850 - DNA, 23 bp, Tribolium castaneum
cccgatgagaagatccggatgaa

SEQ ID NO: 851 - DNA, 21 bp, Tribolium castaneum
ctgccccgatgagaagatccg

SEQ ID NO: 852 - DNA, 23 bp, Tribolium castaneum
aacgaaaccggtgctttcttctt

SEQ ID NO: 853 - DNA, 23 bp, Tribolium castaneum
atcatggaatattacgagaagaa

SEQ ID NO: 854 - DNA, 26 bp, Tribolium castaneum
aacggtcccgaaattatgagtaaatt

SEQ ID NO: 855 - DNA, 24 bp, Tribolium castaneum
aacaggctgaagtatgccttgacc

SEQ ID NO: 856 - DNA, 21 bp, Tribolium castaneum
ttcatcgtccgtggtggcatg

SEQ ID NO: 857 - DNA, 21 bp, Tribolium castaneum
agttttaccggtacctggagg

SEQ ID NO: 858 - DNA, 21 bp, Tribolium castaneum
cctccaggtaccggtaaaact

SEQ ID NO: 859 - DNA, 23 bp, Tribolium castaneum
cctccaggtaccggtaaaacttt

SEQ ID NO: 860 - DNA, 26 bp, Tribolium castaneum
attaaagttttaccggtacctggagg

SEQ ID NO: 861 - DNA, 23 bp, Tribolium castaneum
ggtgctttcttcttcttaatcaa

SEQ ID NO: 862 - DNA, 21 bp, Tribolium castaneum
atcaacggtcccgaaattatg

SEQ ID NO: 863 - DNA, 510 bp, Tribolium castaneum
ctgcgaaacaggctgaagtatgccttgaccaactcagaagtgacgaagattgttatgcaaagattgattaaagttgacggaaaagttaggacagaccccaactaccccgcgggtttcatggatgttgtgactattgagaaaactggggaattcttccgcttgatttatgatgttaagggaaggttcacaatccatcgcattactggagaagaggccaaatataaattgtgcaaagtgaagaaagtacagacaggccccaagggcattcccttcttggtgacccgcgacggacgcactatcagatacccagaccccatgatcaaagtgaatgacaccattcaattggagattgccacttcgaaaattcttgattttatcaaatttgagtccggtaatttgtgtatgattactggaggtcgtaacttggggcgtgtcggtacagtggtgagccgagaacgtcacccaggttccttcgacatcgttcatattaaggatgcaaatgggcacacc

SEQ ID NO: 864 - DNA, 45 bp, artificial sequence
  Description of artificial sequence:  synthetic primer
gcgtaatacgactcactataggctgcgaaacaggctgaagtatgc

SEQ ID NO: 865 - DNA, 20 bp, artificial sequence
  Description of artificial sequence:  synthetic primer
ggtgtgcccatttgcatcct

SEQ ID NO: 866 - DNA, 23 bp, artificial sequence
  Description of artificial sequence:  synthetic primer
ctgcgaaacaggctgaagtatgc

SEQ ID NO: 867 - DNA, 42 bp, artificial sequence
  Description of artificial sequence:  synthetic primer
gcgtaatacgactcactataggggtgtgcccatttgcatcct

SEQ ID NO: 868 - DNA, 195 bp, Tribolium castaneum
catccatgttgaggtgggcatttttgagggcgtccgctgcgtttttcatcgttttgagtacggctgtgttggtgttggccccctcgagggcctcccgctgcatctcgatggtgctgagggtgccatcgatctgctggagctgcttttcgtagcgtttcttcctcttgatggcctggatggccgctgttcacaaag

SEQ ID NO: 869 - DNA, 42 bp, artificial sequence
  Description of artificial sequence:  synthetic primer
gcgtaatacgactcactataggcatccatgttgaggtgggca

SEQ ID NO: 870 - DNA, 20 bp, artificial sequence
  Description of artificial sequence:  synthetic primer
ctttgtgaacagcggccatc

SEQ ID NO: 871 - DNA, 20 bp, artificial sequence
  Description of artificial sequence:  synthetic primer
catccatgttgaggtgggca

SEQ ID NO: 872 - DNA, 42 bp, artificial sequence
  Description of artificial sequence:  synthetic primer
gcgtaatacgactcactataggctttgtgaacagcggccatc

SEQ ID NO: 873 - DNA, 284 bp, Tribolium castaneum
atgtcctggtacttgaggttcctccattgggcgattgtctcaccgtggaaaatcaaaatttggaaaaatgtgtccatgagaaggatccgatcgggttgaatggaactagtgtcgaggaggacgggttcaggggggccgttgaaactataactgtacaaaatcggctggatcataatgagactttgggtgaggtcctcccgcatcagcatgtggcggtagaacgaggtctcgtctggggagttgttgaaaacttggaggaattgggagcggcgcaaatggtacat

SEQ ID NO: 874 - DNA, 42 bp, artificial sequence
  Description of artificial sequence:  synthetic primer
gcgtaatacgactcactataggatgtaccatttgcgccgctc

SEQ ID NO: 875 - DNA, 25 bp, artificial sequence
  Description of artificial sequence:  synthetic primer
atgtcctggtacttgaggttcctcc

SEQ ID NO: 876 - DNA, 20 bp, artificial sequence
  Description of artificial sequence:  synthetic primer
atgtaccatttgcgccgctc

SEQ ID NO: 877 - DNA, 47 bp, artificial sequence
  Description of artificial sequence:  synthetic primer
gcgtaatacgactcactataggatgtcctggtacttgaggttcctcc

SEQ ID NO: 878 - DNA, 526 bp, Tribolium castaneum
caacagcgcttgaagatcatggaatattacgagaagaaggagaaaccggtggaattgcagaagaaaattcagtcgtcaaacatgctgaaccaagcccgtttgaaagtattaaaagtgcgtgaagaccacgtccacaatgtgctggatgacgcccgcaaacgtctgggcgaaatcaccaatgaccaggcgagatattcacaacttttggagtctcttatcctccagagtctctaccagtacttgggaatcagtgatgagttgtttgagaacaatatagtggtgagagtcaggcaacaggacaggagtataatccagggcattctcccagttgttgcgacgaaatacagggacgccactggtaaagacgttcatcttaaaatcgacgatgagagccacttgccatccgaaaccaccggaggagtggttttgtatgcgcaaaagggtaaaatcaagattgacaacaccttggaggctcgtttggatttaattgcacagcaacttgtgccagaaattcgtacggccttgt

SEQ ID NO: 879 - DNA, 44 bp, artificial sequence
  Description of artificial sequence:  synthetic primer
gcgtaatacgactcactataggcaacagcgcttgaagatcatgg

SEQ ID NO: 880 - DNA, 22 bp, artificial sequence
  Description of artificial sequence:  synthetic primer
acaaggccgtacgaatttctgg

SEQ ID NO: 881 - DNA, 22 bp, artificial sequence
  Description of artificial sequence:  synthetic primer
caacagcgcttgaagatcatgg

SEQ ID NO: 882 - DNA, 44 bp, artificial sequence
  Description of artificial sequence:  synthetic primer
gcgtaatacgactcactataggacaaggccgtacgaatttctgg

SEQ ID NO: 883 - DNA, 687 bp, Tribolium castaneum
cgatacagtgttgctgaaagggaagcggcggaaagagaccgtctgcattgtgctggccgacgaaaactgccccgatgagaagatccggatgaacaggatcgtcaggaataatctacgggttaggctctctgacgtcgtctggatccagccctgtcccgacgtcaaatacgggaagaggatccacgttttgcccatcgatgacacggtcgaagggctcgtcggaaatctcttcgaggtgtacttaaaaccatacttcctcgaagcttatcgaccaatccacaaaggcgacgttttcatcgtccgtggtggcatgcgagccgttgaattcaaagtggtggaaacggaaccgtcaccatattgtatcgtcgcccccgataccgtcatccattgtgacggcgatccgatcaaacgagaagaagaggaggaagccttgaacgccgtcggctacgacgatatcggcggttgtcgcaaacaactcgcacaaatcaaagaaatggtcgaattacctctacgccacccgtcgctcttcaaggccattggcgtgaaaccaccacgtggtatcctcttgtacggacctccaggtaccggtaaaactttaatcgcacgtgcagtggccaacgaaaccggtgctttcttcttcttaatcaacggtcccgaaattatgagtaaattagccggcgaatccga

SEQ ID NO: 884 - DNA, 47 bp, artificial sequence
  Description of artificial sequence:  synthetic primer
gcgtaatacgactcactataggcgatacagtgttgctgaaagggaag

SEQ ID NO: 885 - DNA, 22 bp, artificial sequence
  Description of artificial sequence:  synthetic primer
tcggattcgccggctaatttac

SEQ ID NO: 886 - DNA, 25 bp, artificial sequence
  Description of artificial sequence:  synthetic primer
cgatacagtgttgctgaaagggaag

SEQ ID NO: 887 - DNA, 44 bp, artificial sequence
  Description of artificial sequence:  synthetic primer
gcgtaatacgactcactataggtcggattcgccggctaatttac

SEQ ID NO: 888 - DNA, 734 bp, Myzus persicae
ggccccaagaagcatttgaagcgtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattgttaccaacagggaaagacatccaggatcttttgatattgttcacattaaggatgcaaatgaacatatttttgctacccggatgaacaatgtttttattattggaaaaggtcaaaagaactacatttctctaccaaggagtaagggagttaaattgactat

SEQ ID NO: 889 - protein, 244 aa, Myzus persicae
GPKKHLKRLNAPKAWMLDKSGGVFAPRPSTGPHKLRESLPLLIFLRNRLKYALTGAEVTKIVMQRLIKVDGKVRTDPNYPAGFMDVISIQKTSEHFRLIYDVKGRFTIHRITPEEAKYKLCKVKRVQTGPKGVPFLTTHDGRTIRYPDPNIKVNDTIRYDIASSKILDHIRFETGNLCMITGGRNLGRVGIVTNRERHPGSFDIVHIKDANEHIFATRMNNVFIIGKGQKNYISLPRSKGVKLT

SEQ ID NO: 890 - DNA, 396 bp, Myzus persicae
gagtttctttagtaaagtattcggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagctcatcaaaacatgaatgtagatgatgtacatgatctgatggatgacattgc

SEQ ID NO: 891 - protein, 131 aa, Myzus persicae
SFFSKVFGGKKEEKGPSTEDAIQKLRSTEEMLIKKQEFLEKKIEQEVAIAKKNGTTNKRAALQALKRKKRYEQQLAQIDGTMLTIEQQREALEGANTNTAVLTTMKTAADALKSAHQNMNVDDVHDLMDDI

SEQ ID NO: 892 - DNA, 845 bp, Myzus persicae
gtggctgcatacagttcattacgcagtatcaacattccagtggctataaacgaattagagtcaccacattagctaggaattgggcagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgcctcggtatattgacacagaacaaggtggtagtcaggcaagatttttactatgcaaagtaaacccatctcaaacacataataatatgtatgcttatggagggtgatggtggagcaccagttttgacagatgatgtaagcttgcagctgttcatggagcagccgcg

SEQ ID NO: 893 - protein, 279 aa, Myzus persicae
GCIQFITQYQHSSGYKRIRVTTLARNWADPVQNMMHVSAAFDQEASAVLMARMVVNRAETEDSPDVMRWADRTLIRLCQKFGDYQKDDPNSFRLPENFSLYPQFMYHLRRSQFLQVFNNSPDETSYYRHMLMREDVTQSLIMIQPILYSYSFNGRPEPVLLDTSSIQPDKILLMDTFFHILIFHGETIAQWRAMDYQNRPEYSNLKQLLQAPVDDAQEILKTRFPMPRYIDTEQGGSQARFLLCKVNPSQTHNNMYAYGGWWSTSFDRCKLAAVHGAAA

SEQ ID NO: 894 - DNA, 734 bp, Myzus persicae
gtgtcggaggatatgttgggccgcgttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacgtcttgctttaactgctgctgaatttttagcttaccaatgtgaaaagcatgtcttagttattttaactgacatgagttcatatgctgaagctttaagagaagtttctgctgctcgtgaagaagtacctgggcgtcgtggtttccctggttacatgtacaccgatttagctacaatttatgaacgtgctgggcgtgtagaaggaagaaatggttctatcacacaaatacctattttaactatgcctaacgacgacatcacccatcctattcc

SEQ ID NO: 895 - protein, 244 aa, Myzus persicae
VSEDMLGRVFNGSGKPIDKGPPILAEDYLDIEGQPINPYSRTYPQEMIQTGISAIDIMNSIARGQKIPIFSAAGLPHNEIAAQICRQAGLVKKPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 896 - DNA, 1041 bp, Myzus persicae
cgccgattaccaaaacaagacgtgtgttcagacattagaaggccatgctcaaaatatttctgctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttggaggttatttgttaggtgtgaaatctgttactgggttggctttatatgattgggaaaatggtaacttagttcgaagaattgagacacaacctaaacatgtattttggtcagagtctggagaattagtatgtcttgccacagatgaagcatactttattttacgttttgacgtcaatgtacttagtgctgcaagagcatccaattatgaagctgctagtcctgatggtcttgaagatgcctttgagattttaggagaagttcaagaagttgtaaaaactggtctatgggttggtgattgctttatttacaccaatggagtaaatcgtatcaactattatgttggtggtgaagttgtgacagtatccc

SEQ ID NO: 897 - protein, 345 aa, Myzus persicae
PITKTRRVFRHKAMLKIFLLVCFHPELPIVLTGSEDGTVRIWHSGTYRLESSLNYGLERVWTICCLRGSNNVALGYDEGSIMVKVGREEPAMSMDVHGGKIVWARHSEIQQANLKAMLQAEGAEIKDGERLPIQVKDMGSCEIYPQSISHNPNGRFLVVCGDGEYIIYTSMALRNKAFGSAQDFVWSSDSEYAIRENSSTIKVFKNFKEKKSFKPEGGADGIFGGYLLGVKSVTGLALYDWENGNLVRRIETQPKHVFWSESGELVCLATDEAYFILRFDVNVLSAARASNYEAASPDGLEDAFEILGEVQEVVKTGLWVGDCFIYTNGVNRINYYVGGEVVTVS

SEQ ID NO: 898 - DNA, 23 bp, artificial sequence
  Description of artificial sequence:  synthetic primer
ggccccaagaagcatttgaagcg

SEQ ID NO: 899 - DNA, 23 bp, artificial sequence
  Description of artificial sequence:  synthetic primer
  misc_feature (18)..(18): n is a, c, g, or t
cgcttgtcccgctcctcngcrat

SEQ ID NO: 900 - DNA, 27 bp, artificial sequence
  Description of artificial sequence:  synthetic primer
gagtttctttagtaaagtattcggtgg

SEQ ID NO: 901 - DNA, 26 bp, artificial sequence
  Description of artificial sequence:  synthetic primer
gcaatgtcatccatcakrtcrtgtac

SEQ ID NO: 902 - DNA, 26 bp, artificial sequence
  Description of artificial sequence:  synthetic primer
gtggctgcatacagttcattacgcag

SEQ ID NO: 903 - DNA, 23 bp, artificial sequence
  Description of artificial sequence:  synthetic primer
cgcggctgctccatgaayasytg

SEQ ID NO: 904 - DNA, 23 bp, artificial sequence
  Description of artificial sequence:  synthetic primer
gtgtcggaggatatgytgggycg

SEQ ID NO: 905 - DNA, 24 bp, artificial sequence
  Description of artificial sequence:  synthetic primer
ggaataggatgggtratrtcgtcg

SEQ ID NO: 906 - DNA, 24 bp, artificial sequence
  Description of artificial sequence:  synthetic primer
cgccgattaccaaaacaaracbtg

SEQ ID NO: 907 - DNA, 25 bp, artificial sequence
  Description of artificial sequence:  synthetic primer
gggatactgtcacaayytcdccrcc

SEQ ID NO: 908 - DNA, 21 bp, Myzus persicae
aaagcatggatgttggacaaa

SEQ ID NO: 909 - DNA, 22 bp, Myzus persicae
aaagcatggatgttggacaaat

SEQ ID NO: 910 - DNA, 29 bp, Myzus persicae
aagaagcatttgaagcgtttaaacgcacc

SEQ ID NO: 911 - DNA, 23 bp, Myzus persicae
aagcatttgaagcgtttaaacgc

SEQ ID NO: 912 - DNA, 26 bp, Myzus persicae
aagcatttgaagcgtttaaacgcacc

SEQ ID NO: 913 - DNA, 28 bp, Myzus persicae
aagtccgtaccgaccctaattatccagc

SEQ ID NO: 914 - DNA, 22 bp, Myzus persicae
acgcacccaaagcatggatgtt

SEQ ID NO: 915 - DNA, 21 bp, Myzus persicae
actattagatacgatattgca

SEQ ID NO: 916 - DNA, 50 bp, Myzus persicae
actggacccaaaggtgtgccatttttaactactcatgatggccgtactat

SEQ ID NO: 917 - DNA, 22 bp, Myzus persicae
agaagcatttgaagcgtttaaa

SEQ ID NO: 918 - DNA, 28 bp, Myzus persicae
agaagcatttgaagcgtttaaacgcacc

SEQ ID NO: 919 - DNA, 51 bp, Myzus persicae
agaagcatttgaagcgtttaaacgcacccaaagcatggatgttggacaaat

SEQ ID NO: 920 - DNA, 22 bp, Myzus persicae
agtaagggagttaaattgacta

SEQ ID NO: 921 - DNA, 22 bp, Myzus persicae
atacaagttgtgtaaagtaaag

SEQ ID NO: 922 - DNA, 71 bp, Myzus persicae
atggatgttatatctatccaaaagaccagtgagcactttagattgatctatgatgtgaaaggtcgtttcac

SEQ ID NO: 923 - DNA, 30 bp, Myzus persicae
attgatctatgatgtgaaaggtcgtttcac

SEQ ID NO: 924 - DNA, 29 bp, Myzus persicae
caaaagaccagtgagcactttagattgat

SEQ ID NO: 925 - DNA, 23 bp, Myzus persicae
cacagaattactcctgaagaagc

SEQ ID NO: 926 - DNA, 33 bp, Myzus persicae
cacagaattactcctgaagaagcaaaatacaag

SEQ ID NO: 927 - DNA, 32 bp, Myzus persicae
catccaggatcttttgatattgttcacattaa

SEQ ID NO: 928 - DNA, 59 bp, Myzus persicae
catccaggatcttttgatattgttcacattaaggatgcaaatgaacatatttttgctac

SEQ ID NO: 929 - DNA, 52 bp, Myzus persicae
catctaaaattttggatcatatccgttttgaaactggaaacttgtgcatgat

SEQ ID NO: 930 - DNA, 23 bp, Myzus persicae
catttgaagcgtttaaacgcacc

SEQ ID NO: 931 - DNA, 38 bp, Myzus persicae
catttgaagcgtttaaacgcacccaaagcatggatgtt

SEQ ID NO: 932 - DNA, 22 bp, Myzus persicae
ccaaagcatggatgttggacaa

SEQ ID NO: 933 - DNA, 28 bp, Myzus persicae
ccaaggagtaagggagttaaattgacta

SEQ ID NO: 934 - DNA, 21 bp, Myzus persicae
cccaaagcatggatgttggac

SEQ ID NO: 935 - DNA, 23 bp, Myzus persicae
cccaaagcatggatgttggacaa

SEQ ID NO: 936 - DNA, 24 bp, Myzus persicae
cccaaagcatggatgttggacaaa

SEQ ID NO: 937 - DNA, 25 bp, Myzus persicae
cccaaagcatggatgttggacaaat

SEQ ID NO: 938 - DNA, 26 bp, Myzus persicae
cgtccaagcaccggtccacacaaact

SEQ ID NO: 939 - DNA, 28 bp, Myzus persicae
ctggaaacttgtgcatgataactggagg

SEQ ID NO: 940 - DNA, 125 bp, Myzus persicae
gaaagacatccaggatcttttgatattgttcacattaaggatgcaaatgaacatatttttgctacccggatgaacaatgtttttattattggaaaaggtcaaaagaactacatttctctaccaag

SEQ ID NO: 941 - DNA, 38 bp, Myzus persicae
gatcatatccgttttgaaactggaaacttgtgcatgat

SEQ ID NO: 942 - DNA, 26 bp, Myzus persicae
gatgcaaatgaacatatttttgctac

SEQ ID NO: 943 - DNA, 23 bp, Myzus persicae
gcacccaaagcatggatgttgga

SEQ ID NO: 944 - DNA, 28 bp, Myzus persicae
gcacccaaagcatggatgttggacaaat

SEQ ID NO: 945 - DNA, 23 bp, Myzus persicae
ggatcttttgatattgttcacat

SEQ ID NO: 946 - DNA, 53 bp, Myzus persicae
ggatcttttgatattgttcacattaaggatgcaaatgaacatatttttgctac

SEQ ID NO: 947 - DNA, 28 bp, Myzus persicae
ggccccaagaagcatttgaagcgtttaa

SEQ ID NO: 948 - DNA, 26 bp, Myzus persicae
gggcgtgttggtattgttaccaacag

SEQ ID NO: 949 - DNA, 32 bp, Myzus persicae
gggcgtgttggtattgttaccaacagggaaag

SEQ ID NO: 950 - DNA, 21 bp, Myzus persicae
ggtacaaactggacccaaagg

SEQ ID NO: 951 - DNA, 41 bp, Myzus persicae
gtttttattattggaaaaggtcaaaagaactacatttctct

SEQ ID NO: 952 - DNA, 22 bp, Myzus persicae
tgaagtatgcacttactggtgc

SEQ ID NO: 953 - DNA, 38 bp, Myzus persicae
tgtaaagtaaagagggtacaaactggacccaaaggtgt

SEQ ID NO: 954 - DNA, 40 bp, Myzus persicae
tgtgtaaagtaaagagggtacaaactggacccaaaggtgt

SEQ ID NO: 955 - DNA, 113 bp, Myzus persicae
ttcttgcgtaatcgtttgaagtatgcacttactggtgccgaagtcaccaagattgtcatgcaaagattaatcaaggttgatggcaaagtccgtaccgaccctaattatccagc

SEQ ID NO: 956 - DNA, 31 bp, Myzus persicae
ttggaaaaggtcaaaagaactacatttctct

SEQ ID NO: 957 - DNA, 41 bp, Myzus persicae
ttggatcatatccgttttgaaactggaaacttgtgcatgat

SEQ ID NO: 958 - DNA, 41 bp, Myzus persicae
aaaaaaaatggtacaactaataaacgagctgcattgcaagc

SEQ ID NO: 959 - DNA, 21 bp, Myzus persicae
aagaaacggtacgaacaacaa

SEQ ID NO: 960 - DNA, 45 bp, Myzus persicae
acaagaatttttagaaaaaaaaattgaacaagaagtagcgatagc

SEQ ID NO: 961 - DNA, 38 bp, Myzus persicae
caaattgatggtaccatgttaactattgaacaacagcg

SEQ ID NO: 962 - DNA, 29 bp, Myzus persicae
gaagatgcgatacaaaagcttcgatccac

SEQ ID NO: 963 - DNA, 27 bp, Myzus persicae
gagtttctttagtaaagtattcggtgg

SEQ ID NO: 964 - DNA, 21 bp, Myzus persicae
aaaagatgatccaaatagttt

SEQ ID NO: 965 - DNA, 44 bp, Myzus persicae
aaaatattattgatggacacatttttccatattttgatattcca

SEQ ID NO: 966 - DNA, 29 bp, Myzus persicae
aatagtcctgatgaaacatcatattatag

SEQ ID NO: 967 - DNA, 101 bp, Myzus persicae
caaaaagatgatccaaatagtttccgattgccagaaaacttcagtttatatccacagttcatgtatcatttaagaaggtctcaatttctacaagtttttaa

SEQ ID NO: 968 - DNA, 26 bp, Myzus persicae
caacattccagtggctataaacgaat

SEQ ID NO: 969 - DNA, 26 bp, Myzus persicae
cacatgttgatgcgtgaagatgttac

SEQ ID NO: 970 - DNA, 59 bp, Myzus persicae
ccaattctgtatagctatagttttaatggtaggccagaacctgtacttttggataccag

SEQ ID NO: 971 - DNA, 38 bp, Myzus persicae
ccatctcaaacacataataatatgtatgcttatggagg

SEQ ID NO: 972 - DNA, 80 bp, Myzus persicae
ctcaaaactcgattcccaatgcctcggtatattgacacagaacaaggtggtagtcaggcaagatttttactatgcaaagt

SEQ ID NO: 973 - DNA, 44 bp, Myzus persicae
ggtgatggtggagcaccagttttgacagatgatgtaagcttgca

SEQ ID NO: 974 - DNA, 28 bp, Myzus persicae
gtggctgcatacagttcattacgcagta

SEQ ID NO: 975 - DNA, 37 bp, Myzus persicae
taatggctcgtatggtagtgaaccgtgctgaaactga

SEQ ID NO: 976 - DNA, 27 bp, Myzus persicae
tataggcacatgttgatgcgtgaagat

SEQ ID NO: 977 - DNA, 32 bp, Myzus persicae
tgggctgatcgtacgcttatacgcttgtgtca

SEQ ID NO: 978 - DNA, 26 bp, Myzus persicae
ttagctaggaattgggcagaccctgt

SEQ ID NO: 979 - DNA, 23 bp, Myzus persicae
aaacaagattttgaggaaaatgg

SEQ ID NO: 980 - DNA, 22 bp, Myzus persicae
aacctggtaaatcagttcttga

SEQ ID NO: 981 - DNA, 25 bp, Myzus persicae
aacgacgacatcacccatcctattc

SEQ ID NO: 982 - DNA, 26 bp, Myzus persicae
aatttagctaatgatcctactattga

SEQ ID NO: 983 - DNA, 29 bp, Myzus persicae
actatgcctaacgacgacatcacccatcc

SEQ ID NO: 984 - DNA, 35 bp, Myzus persicae
atagtatttgctgctatgggtgttaatatggaaac

SEQ ID NO: 985 - DNA, 23 bp, Myzus persicae
caaatttgtagacaagctggtct

SEQ ID NO: 986 - DNA, 53 bp, Myzus persicae
catgaagacaattttgctatagtatttgctgctatgggtgttaatatggaaac

SEQ ID NO: 987 - DNA, 71 bp, Myzus persicae
ccgatagataaaggacctcctattttggctgaagattatttggatattgaaggccaacctattaatccata

SEQ ID NO: 988 - DNA, 21 bp, Myzus persicae
cctattttggctgaagattat

SEQ ID NO: 989 - DNA, 50 bp, Myzus persicae
cgtatcattacaccacgtcttgctttaactgctgctgaatttttagctta

SEQ ID NO: 990 - DNA, 35 bp, Myzus persicae
cgtcttgctttaactgctgctgaatttttagctta

SEQ ID NO: 991 - DNA, 44 bp, Myzus persicae
gaagaagtacctgggcgtcgtggtttccctggttacatgtacac

SEQ ID NO: 992 - DNA, 50 bp, Myzus persicae
gaaggaagaaatggttctatcacacaaatacctattttaactatgcctaa

SEQ ID NO: 993 - DNA, 53 bp, Myzus persicae
gaaggaagaaatggttctatcacacaaatacctattttaactatgcctaacga

SEQ ID NO: 994 - DNA, 23 bp, Myzus persicae
gatttagctacaatttatgaacg

SEQ ID NO: 995 - DNA, 35 bp, Myzus persicae
gccagattctttaaacaagattttgaggaaaatgg

SEQ ID NO: 996 - DNA, 23 bp, Myzus persicae
gctatgggtgttaatatggaaac

SEQ ID NO: 997 - DNA, 41 bp, Myzus persicae
gctgcaggtttaccacataatgagattgctgctcaaatttg

SEQ ID NO: 998 - DNA, 65 bp, Myzus persicae
gctgggcgtgtagaaggaagaaatggttctatcacacaaatacctattttaactatgcctaacga

SEQ ID NO: 999 - DNA, 38 bp, Myzus persicae
ggttacatgtacaccgatttagctacaatttatgaacg

SEQ ID NO: 1000 - DNA, 25 bp, Myzus persicae
gtggacaaaaaattccaatattttc

SEQ ID NO: 1001 - DNA, 23 bp, Myzus persicae
gtgtcggaggatatgttgggccg

SEQ ID NO: 1002 - DNA, 33 bp, Myzus persicae
gttcttgaatttagctaatgatcctactattga

SEQ ID NO: 1003 - DNA, 53 bp, Myzus persicae
tcaatggagaatgtttgtttgttcttgaatttagctaatgatcctactattga

SEQ ID NO: 1004 - DNA, 56 bp, Myzus persicae
tcagctattgatatcatgaactctattgctcgtggacaaaaaattccaatattttc

SEQ ID NO: 1005 - DNA, 38 bp, Myzus persicae
tcatatgctgaagctttaagagaagtttctgctgctcg

SEQ ID NO: 1006 - DNA, 38 bp, Myzus persicae
tccagaacatatcctcaagaaatgattcaaactggtat

SEQ ID NO: 1007 - DNA, 26 bp, Myzus persicae
tctattgctcgtggacaaaaaattcc

SEQ ID NO: 1008 - DNA, 107 bp, Myzus persicae
tgtgaaaagcatgtcttagttattttaactgacatgagttcatatgctgaagctttaagagaagtttctgctgctcgtgaagaagtacctgggcgtcgtggtttccc

SEQ ID NO: 1009 - DNA, 68 bp, Myzus persicae
ttaactgacatgagttcatatgctgaagctttaagagaagtttctgctgctcgtgaagaagtacctgg

SEQ ID NO: 1010 - DNA, 25 bp, Myzus persicae
tttttaaaaattttaaagaaaaaaa

SEQ ID NO: 1011 - DNA, 25 bp, Myzus persicae
gatcttttgatattgttcacattaa

SEQ ID NO: 1012 - DNA, 28 bp, Myzus persicae
acatccaggatcttttgatattgttcac

SEQ ID NO: 1013 - DNA, 23 bp, Myzus persicae
tcttttgatattgttcacattaa

SEQ ID NO: 1014 - DNA, 21 bp, Myzus persicae
tattgctcgtggacaaaaaat

SEQ ID NO: 1015 - DNA, 26 bp, Myzus persicae
tctgctgctcgtgaagaagtacctgg

SEQ ID NO: 1016 - DNA, 21 bp, Myzus persicae
gctgaagattatttggatatt

SEQ ID NO: 1017 - DNA, 26 bp, Myzus persicae
ggtttaccacataatgagattgctgc

SEQ ID NO: 1018 - DNA, 35 bp, Myzus persicae
aagaaatgattcaaactggtatttcagctattgat

SEQ ID NO: 1019 - DNA, 27 bp, Myzus persicae
tattgctcgtggacaaaaaattccaat

SEQ ID NO: 1020 - DNA, 23 bp, Myzus persicae
gtttctgctgctcgtgaagaagt

SEQ ID NO: 1021 - DNA, 26 bp, Myzus persicae
cgtggtttccctggttacatgtacac

SEQ ID NO: 1022 - DNA, 23 bp, Myzus persicae
cctggttacatgtacaccgattt

SEQ ID NO: 1023 - DNA, 21 bp, Myzus persicae
tttaaaaattttaaagaaaaa

SEQ ID NO: 1024 - DNA, 24 bp, Myzus persicae
ctattatgttggtggtgaagttgt

SEQ ID NO: 1025 - DNA, 21 bp, Myzus persicae
aaagtttttaaaaattttaaa

SEQ ID NO: 1026 - DNA, 21 bp, Myzus persicae
aatttttagaaaaaaaaattg

SEQ ID NO: 1027 - DNA, 21 bp, Myzus persicae
gtcaccacattagctaggaat

SEQ ID NO: 1028 - DNA, 22 bp, Myzus persicae
aagaaatgattcaaactggtat

SEQ ID NO: 1029 - DNA, 25 bp, Myzus persicae
aagaaatgattcaaactggtatttc

SEQ ID NO: 1030 - DNA, 21 bp, Myzus persicae
catgaactctattgctcgtgg

SEQ ID NO: 1031 - DNA, 23 bp, Myzus persicae
gctgctatgggtgttaatatgga

SEQ ID NO: 1032 - DNA, 24 bp, Myzus persicae
tgctatgggtgttaatatggaaac

SEQ ID NO: 1033 - DNA, 23 bp, Myzus persicae
cctactattgagcgtatcattac

SEQ ID NO: 1034 - DNA, 32 bp, Myzus persicae
gaagtttctgctgctcgtgaagaagtacctgg

SEQ ID NO: 1035 - DNA, 23 bp, Myzus persicae
gtttctgctgctcgtgaagaagt

SEQ ID NO: 1036 - DNA, 26 bp, Myzus persicae
gtgtacatgtaaccagggaaaccacg

SEQ ID NO: 1037 - DNA, 23 bp, Myzus persicae
cctggttacatgtacaccgattt

SEQ ID NO: 1038 - DNA, 21 bp, Myzus persicae
ggttacatgtacaccgattta

SEQ ID NO: 1039 - DNA, 23 bp, Myzus persicae
cctattttaactatgcctaacga

SEQ ID NO: 1040 - DNA, 21 bp, Myzus persicae
actctccatcaccacatacta

SEQ ID NO: 1041 - DNA, 552 bp, Myzus persicae
gtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattg

SEQ ID NO: 1042 - DNA, 45 bp, artificial sequence
  Description of artificial sequence:  synthetic primer
gcgtaatacgactcactatagggtttaaacgcacccaaagcatgg

SEQ ID NO: 1043 - DNA, 24 bp, artificial sequence
  Description of artificial sequence:  synthetic primer
caataccaacacgccctaaattgc

SEQ ID NO: 1044 - DNA, 23 bp, artificial sequence
  Description of artificial sequence:  synthetic primer
gtttaaacgcacccaaagcatgg

SEQ ID NO: 1045 - DNA, 46 bp, artificial sequence
  Description of artificial sequence:  synthetic primer
gcgtaatacgactcactataggcaataccaacacgccctaaattgc

SEQ ID NO: 1046 - DNA, 323 bp, Myzus persicae
ggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagc

SEQ ID NO: 1047 - DNA, 44 bp, artificial sequence
  Description of artificial sequence:  synthetic primer
gcgtaatacgactcactataggggtggcaaaaaggaagagaagg

SEQ ID NO: 1048 - DNA, 23 bp, artificial sequence
  Description of artificial sequence:  synthetic primer
gctgatttaagtgcatctgctgc

SEQ ID NO: 1049 - DNA, 22 bp, artificial sequence
  Description of artificial sequence:  synthetic primer
ggtggcaaaaaggaagagaagg

SEQ ID NO: 1050 - DNA, 45 bp, artificial sequence
  Description of artificial sequence:  synthetic primer
gcgtaatacgactcactatagggctgatttaagtgcatctgctgc

SEQ ID NO: 1051 - DNA, 597 bp, Myzus persicae
cagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgc

SEQ ID NO: 1052 - DNA, 42 bp, artificial sequence
  Description of artificial sequence:  synthetic primer
gcgtaatacgactcactataggcagaccctgttcagaatatg

SEQ ID NO: 1053 - DNA, 22 bp, artificial sequence
  Description of artificial sequence:  synthetic primer
gcattgggaatcgagttttgag

SEQ ID NO: 1054 - DNA, 20 bp, artificial sequence
  Description of artificial sequence:  synthetic primer
cagaccctgttcagaatatg

SEQ ID NO: 1055 - DNA, 44 bp, artificial sequence
  Description of artificial sequence:  synthetic primer
gcgtaatacgactcactatagggcattgggaatcgagttttgag

SEQ ID NO: 1056 - DNA, 440 bp, Myzus persicae
gttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacg

SEQ ID NO: 1057 - DNA, 44 bp, artificial sequence
  Description of artificial sequence:  synthetic primer
gcgtaatacgactcactatagggttttcaatggcagtggaaagc

SEQ ID NO: 1058 - DNA, 20 bp, artificial sequence
  Description of artificial sequence:  synthetic primer
cgtggtgtaatgatacgctc

SEQ ID NO: 1059 - DNA, 22 bp, artificial sequence
  Description of artificial sequence:  synthetic primer
gttttcaatggcagtggaaagc

SEQ ID NO: 1060 - DNA, 42 bp, artificial sequence
  Description of artificial sequence:  synthetic primer
gcgtaatacgactcactataggcgtggtgtaatgatacgctc

SEQ ID NO: 1061 - DNA, 615 bp, Myzus persicae
gctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttgg

SEQ ID NO: 1062 - DNA, 45 bp, artificial sequence
  Description of artificial sequence:  synthetic primer
gcgtaatacgactcactatagggctcgtttgtttccatccagaac

SEQ ID NO: 1063 - DNA, 23 bp, artificial sequence
  Description of artificial sequence:  synthetic primer
ccaaaaataccatctgctccacc

SEQ ID NO: 1064 - DNA, 23 bp, artificial sequence
  Description of artificial sequence:  synthetic primer
gctcgtttgtttccatccagaac

SEQ ID NO: 1065 - DNA, 45 bp, artificial sequence
  Description of artificial sequence:  synthetic primer
gcgtaatacgactcactataggccaaaaataccatctgctccacc

SEQ ID NO: 1066 - DNA, 2616 bp, Myzus persicae
gtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcaataccaacacgccctaaattgcgacctccagttatcatgcacaagtttccagtttcaaaacggatatgatccaaaattttagatgatgcaatatcgtatctaatagtgtcattaaccttgatgttagggtcagggtagcgaatagtacggccatcatgagtagttaaaaatggcacacctttgggtccagtttgtaccctctttactttacacaacttgtattttgcttcttcaggagtaattctgtggatggtgaaacgacctttcacatcatagatcaatctaaagtgctcactggtcttttggatagatataacatccataaaaccggctggataattagggtcggtacggactttgccatcaaccttgattaatctttgcatgacaatcttggtgacttcggcaccagtaagtgcatacttcaaacgattacgcaagaagatcaataacggtagtgattcacgaagtttgtgtggaccggtgcttggacgtggagcgaagacaccccccgatttgtccaacatccatgctttgggtgcgtttaaac

SEQ ID NO: 1067 - DNA, 2158 bp, Myzus persicae
gctgatttaagtgcatctgctgcagttttcatggtagtcaatactgctgtatttgtgttggcaccttctaatgcctcccgctgttgttcaatagttaacatggtaccatcaatttgggctaattgttgttcgtaccgtttcttacgcttcaatgcttgcaatgcagctcgtttattagttgtaccattttttttggctatcgctacttcttgttcaatttttttttctaaaaattcttgtttctttatcagcatctcttcagtggatcgaagcttttgtatcgcatcttcggttgatggtcccttctcttcctttttgccaccaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagc

SEQ ID NO: 1068 - DNA, 2706 bp, Myzus persicae
cagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgcattgggaatcgagttttgagaatttcctgagcatcatcaacgggggcttgaagcaactgcttgaggttactatactctggtctattttgataatccattgctctccattgagcaatagtctctccatggaatatcaaaatatggaaaaatgtgtccatcaataatattttatcaggttgaatactactggtatccaaaagtacaggttctggcctaccattaaaactatagctatacagaattggctgtatcatgattaaactttgggtaacatcttcacgcatcaacatgtgcctataatatgatgtttcatcaggactattattaaaaacttgtagaaattgagaccttcttaaatgatacatgaactgtggatataaactgaagttttctggcaatcggaaactatttggatcatctttttgataatcaccaaatttttgacacaagcgtataagcgtacgatcagcccaacgcatcacatctggactatcctcagtttcagcacggttcactaccatacgagccattaaaacggcagatgcttcttgatcaaatgcagcactaacatgcatcatattctgaacagggtctg

SEQ ID NO: 1069 - DNA, 2392 bp, Myzus persicae
gttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcgtggtgtaatgatacgctcaatagtaggatcattagctaaattcaagaacaaacaaacattctccattgaaccattttcctcaaaatcttgtttaaagaatctggctgtttccatattaacacccatagcagcaaatactatagcaaaattgtcttcatgatcgtcaagaactgatttaccaggttttttaacgagaccagcttgtctacaaatttgagcagcaatctcattatgtggtaaacctgcagctgaaaatattggaattttttgtccacgagcaatagagttcatgatatcaatagctgaaataccagtttgaatcatttcttgaggatatgttctggagtatggattaataggttggccttcaatatccaaataatcttcagccaaaataggaggtcctttatctatcggctttccactgccattgaaaac

SEQ ID NO: 1070 - DNA, 2742 bp, Myzus persicae
ccaaaaataccatctgctccaccttctggtttaaaagactttttttctttaaaatttttaaaaactttgattgtagaagaattttctctaatggcatactcagaatcagaagaccatacaaaatcctgagcggagccaaatgctttattacgcaaagccattgatgtatatataatatactctccatcaccacatactactaaaaatctaccattcggattatgagatattgactgtggataaatttcacagctacccatgtctttaacttgtattggtaaacgttcaccatctttgatttcggctccttctgcttgaagcatcgctttaaggttagcttgttgaatttcactatgacgtgcccaaacaattttacccccatgaacatccattgacattgctggctcttcacgaccaactttaaccattatacttccttcatcataacctagagctacattattagatccccgtaagcaacagattgtccatacacgttctaacccatagtttaatgatgattctaatcgataagtaccagaatgccaaattctgacggtaccatcttctgagccagttaacacgatgggaagttctggatggaaacaaacgagcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttgg

SEQ ID NO: 1071 - DNA, 697 bp, Nilaparvata lugens
gaaatcatggatgttggacaaattgggtggtgtgtatgcaccccgacccagcacaggtccacacaagctgcgagaatctctcccacttgtcatatttttgcgtaatcggctcaagtacgctttaactaactgtgaagtgaagaaaattgtgatgcagcgtctcatcaaggttgacggcaaagtgaggactgaccccaactatcctgcaggttttatggacgttgttcaaatcgaaaagacaaacgagttcttccgtttgatctatgatgttaagggacgtttcaccatccacaggatcacagctgaagaagctaagtacaagctgtgcaaagtgaagagggttcagacaggacccaagggcattccatttttgaccactcacgatggacgcaccatcaggtatccagaccccttggtaaaagtcaatgacaccatccaattggacattgccacatccaaaatcatggacttcatcagattcgactctggtaacctgtgtatgatcactggaggtcgtaacttgggtcgtgtgggcactgtcgtgaacagggagcgacacccggggtctttcgacatcgtgcacatcaaggacgtgttgggacacacttttgccactaggttgaacaacgttttcatcatcggcaagggtagtaaagcatacgtgtctctgcccaagggcaagggtgtgaagctcagt

SEQ ID NO: 1072 - protein, 232 aa, Nilaparvata lugens
KSWMLDKLGGVYAPRPSTGPHKLRESLPLVIFLRNRLKYALTNCEVKKIVMQRLIKVDGKVRTDPNYPAGFMDVVQIEKTNEFFRLIYDVKGRFTIHRITAEEAKYKLCKVKRVQTGPKGIPFLTTHDGRTIRYPDPLVKVNDTIQLDIATSKIMDFIRFDSGNLCMITGGRNLGRVGTVVNRERHPGSFDIVHIKDVLGHTFATRLNNVFIIGKGSKAYVSLPKGKGVKLS

SEQ ID NO: 1073 - DNA, 336 bp, Nilaparvata lugens
gatgaaaagggccctacaactggcgaagccattcagaaactacgcgaaacagaggaaatgctgataaagaaacaagactttttagaaaagaaaattgaagttgaaattggagttgccaggaagaatggaacaaaaaacaaaagagccgcgatccaggcactcaaaaggaagaagaggtatgaaaagcaattgcagcagatcgatggaacgttatcaacaattgagatgcagagagaggccctcgaaggagccaacacgaatacggccgtactgcaaactatgaagaacgcagcagatgctctcaaagcggctcatcaacacatggatgtggatcag

SEQ ID NO: 1074 - protein, 112 aa, Nilaparvata lugens
DEKGPTTGEAIQKLRETEEMLIKKQDFLEKKIEVEIGVARKNGTKNKRAAIQALKRKKRYEKQLQQIDGTLSTIEMQREALEGANTNTAVLQTMKNAADALKAAHQHMDVDQ

SEQ ID NO: 1075 - DNA, 477 bp, Nilaparvata lugens
tccgcgtcgtccttacgagaaggcacgtctcgaacaggagttgaagatcatcggagagtatggactccgtaacaagcgtgaggtgtggagagtcaaatacgccctggccaagattcgtaaggccgctcgtgagctgttgactctggaagagaaggaccagaaacgtttgtttgaaggtaacgccctgctgcgtcgcctggtgcgtattggagtgttggacgaaggaagaatgaagctcgattacgtcttgggtttaaaaattgaagatttccttgaacgtcgtctacagactcaggtgtacaaactcggtttggccaagtccatccatcacgcccgtgtactcatcagacaaagacatatcagagtgcgcaaacaagtagtgaacattccgagctttgtggtgcgcctggactcgcagaagcacattgacttctcgctgaagtcgccgttcggcggtggccgacctggtcgcgtcaa

SEQ ID NO: 1076 - protein, 158 aa, Nilaparvata lugens
PRRPYEKARLEQELKIIGEYGLRNKREVWRVKYALAKIRKAARELLTLEEKDQKRLFEGNALLRRLVRIGVLDEGRMKLDYVLGLKIEDFLERRLQTQVYKLGLAKSIHHARVLIRQRHIRVRKQVVNIPSFVVRLDSQKHIDFSLKSPFGGGRPGRV

SEQ ID NO: 1077 - DNA, 339 bp, Nilaparvata lugens
aaggagttggctgctgtaagaactgtctgctctcacatcgaaaacatgctgaagggagtcacaaagggattcctgtacaagatgcgtgccgtgtacgcccatttccccatcaactgtgtgacgaccgagaacaactctgtgatcgaggtgcgtaacttcctgggcgagaagtacatccgacgggtgaggatggcgcccggcgtcactgttaccaactcgacaaagcagaaggacgagctcatcgtcgaaggaaacagcatagaggacgtgtcaagatcagctgccctcatccaacagtcaacaacagtgaagaacaaggatattcgtaaattcttggac

SEQ ID NO: 1078 - protein, 113 aa, Nilaparvata lugens
KELAAVRTVCSHIENMLKGVTKGFLYKMRAVYAHFPINCVTTENNSVIEVRNFLGEKYIRRVRMAPGVTVTNSTKQKDELIVEGNSIEDVSRSAALIQQSTTVKNKDIRKFLD

SEQ ID NO: 1079 - DNA, 453 bp, Nilaparvata lugens
ttggatcccaatgaaataaatgaaatcgcaaacacaaattcacgtcaaagcatcaggaagctgatcaaagacggtcttatcatcaagaaaccggttgcagtacattcacgtgctcgcgttcgtaaaaacactgaagccaggaggaaaggcagacattgtggctttggtaagaggaaaggtacagccaacgcccgtatgccacaaaaggttctatgggtgaatcgtatgcgtgtcttgagaagactgttgaaaaaatacagacaagataagaaaatcgacaggcatctgtaccatcacctttacatgaaggctaagggtaacgtattcaagaacaagcgtgtattgatggagttcattcataagaagaaggccgagaaagcaagaatgaagatgttgaacgaccaggctgaagctcgcagacaaaaggtcaaggaggccaagaagcgaagggaa

SEQ ID NO: 1080 - protein, 151 aa, Nilaparvata lugens
LDPNEINEIANTNSRQSIRKLIKDGLIIKKPVAVHSRARVRKNTEARRKGRHCGFGKRKGTANARMPQKVLWVNRMRVLRRLLKKYRQDKKIDRHLYHHLYMKAKGNVFKNKRVLMEFIHKKKAEKARMKMLNDQAEARRQKVKEAKKRRE

SEQ ID NO: 1081 - DNA, 1052 bp, Nilaparvata lugens
aagtgcttgtgtcaagtggtgtggtggagtacattgacaccctggaggaggagacgaccatgatagcgatgtcgccggatgacctgcgtcaggacaaggagtatgcctactgtaccacctacacgcactgcgagatccacccggccatgatactcggtgtgtgcgcctctattattcccttccccgatcacaaccaaagtcccaggaacacctatcagagcgctatggggaaacaggcgatgggcgtgtacatcaccaacttccacgtgcgaatggacacgctggctcacgtgctgttctacccgcacaagccactggtcaccactcgctccatggagtacctgcgcttcagggagcttcctgccggcatcaactctgtggtcgccatcgcctgctacactggatacaaccaggaggacagtgtcattctcaacgcctccgctgtcgagcgcggattcttcagatcggttttcttccgatcttacaaagatgcagaatcgaagcgtattggcgaccaagaggagcaattcgagaagcccaccagacagacgtgtcagggaatgaggaatgccatttatgacaaattggacgatgatggcatcattgctcccggtctgagagtgtctggtgacgatgtggttattggcaaaaccataacactgcccgataatgatgacgagctggaaggtacaacaaagaggttcacgaagagagatgccagtactttcctgcgtaacagtgagacgggaatcgtcgaccaagtcatgttaaccttgaactctgagggttacaagttctgcaaaattcgagtcaggtctgtgcgtatcccgcagattggcgataagttcgcttcccgacatggccaaaaaggaacgtgtggaatacagtatcgtcaagaggacatgccttttacaagcgagggaatcgcaccggatattattatcaatcctcacgctatcccatctcgtatgacaattggccatttaattgaatgtctccaaggaaaggtgtcgtcgaacaagggcgagataggtgacgcgacgccgttcaac

SEQ ID NO: 1082 - protein, 350 aa, Nilaparvata lugens
VLVSSGVVEYIDTLEEETTMIAMSPDDLRQDKEYAYCTTYTHCEIHPAMILGVCASIIPFPDHNQSPRNTYQSAMGKQAMGVYITNFHVRMDTLAHVLFYPHKPLVTTRSMEYLRFRELPAGINSVVAIACYTGYNQEDSVILNASAVERGFFRSVFFRSYKDAESKRIGDQEEQFEKPTRQTCQGMRNAIYDKLDDDGIIAPGLRVSGDDVVIGKTITLPDNDDELEGTTKRFTKRDASTFLRNSETGIVDQVMLTLNSEGYKFCKIRVRSVRIPQIGDKFASRHGQKGTCGIQYRQEDMPFTSEGIAPDIIINPHAIPSRMTIGHLIECLQGKVSSNKGEIGDATPFN

SEQ ID NO: 1083 - DNA, 958 bp, Nilaparvata lugens
tttcagagatttccttctgaaacctgaaattttgagagcaatccttgactgtggttttgaacatccatctgaagtacaacatgaatgcattcctcaagctgtacttggaatggacatattgtgtcaagcgaaatccggtatgggaaaaactgctgtatttgtgttggcgacattacagcaaattgaaccaactgacaaccaagtcagtgtattggtcatgtgtcataccagagagcttgcattccaaatcagcaaagagtatgaacgattttcgaaatgtatgccaaatatcaaggttggagttttcttcggcggactgccgattcagagggatgaggagacgttgaaattgaactgtcctcacatcgtggttggaacacccggacgaattttggcgttggtacgcaacaagaagctggacctcaagcatctcaagcactttgtccttgacgaatgtgacaaaatgttggaactgttagatatgcgaagagatgtgcaggaaatattccgaaacacgccgcacagcaaacaagtcatgatgttcagtgcaactctcagcaaagaaattcgtccagtctgcaagaaattcatgcaagatccgatggaagtgtacgttgatgacgaggccaagctgacgcttcacggcctgcagcagcactatgtcaaactcaaagaaaacgaaaagaacaaaaagttatttgaattacttgacatacttgaattcaaccaggttgttatatttgtgaagtcagtgcagcgctgcatggccctatcgcaactcctaacagagcagaacttccctgcagtggctattcaccgtggcatgacacaagaagaacgattgaagaaatatcaagagttcaaagagttcctaaagcgaattttggtagcaacgaatctgtttggcagaggaatggatattgagagagtcaacattgtattcaactatgacatgcct

SEQ ID NO: 1084 - protein, 319 aa, Nilaparvata lugens
FRDFLLKPEILRAILDCGFEHPSEVQHECIPQAVLGMDILCQAKSGMGKTAVFVLATLQQIEPTDNQVSVLVMCHTRELAFQISKEYERFSKCMPNIKVGVFFGGLPIQRDEETLKLNCPHIVVGTPGRILALVRNKKLDLKHLKHFVLDECDKMLELLDMRRDVQEIFRNTPHSKQVMMFSATLSKEIRPVCKKFMQDPMEVYVDDEAKLTLHGLQQHYVKLKENEKNKKLFELLDILEFNQVVIFVKSVQRCMALSQLLTEQNFPAVAIHRGMTQEERLKKYQEFKEFLKRILVATNLFGRGMDIERVNIVFNYDMP

SEQ ID NO: 1085 - DNA, 675 bp, Nilaparvata lugens
ggaaggatagaaaaccagaaacgagttgttggtgttcttttgggatgctggagacctggaggtgtattagatgtttcaaacagttttgcagttccatttgatgaggacgacaaagaaaagaatgtttggttcttagaccatgattacttggaaaacatgttcgggatgttcaagaaagttaatgctagagaaaaggttgtgggttggtaccatactggacccaaactccaccaaaacgatgttgcaatcaatgagttgattcgtcgttactgtccaaactgtgtcttagtcataatcgatgccaagcctaaagatttgggtctacctacagaggcatacagagtcgttgaagaaatccatgatgatggatcgccaacatcaaaaacatttgaacatgtgatgagtgagattggggcagaagaggctgaggagattggcgttgaacatctgttgagagacatcaaagatacaacagtcgggtcactgtcacagcgcgtcacaaatcagctgatgggcttgaagggcttgcatctgcaattacaggatatgcgagactatttgaatcaggttgtcgaaggaaagttgccaatgaaccatcaaatcgtttaccaactgcaagacatcttcaaccttctacccgatatcggccacggcaattttgtagactcgctctac

SEQ ID NO: 1086 - protein, 225 aa, Nilaparvata lugens
GRIENQKRVVGVLLGCWRPGGVLDVSNSFAVPFDEDDKEKNVWFLDHDYLENMFGMFKKVNAREKVVGWYHTGPKLHQNDVAINELIRRYCPNCVLVIIDAKPKDLGLPTEAYRVVEEIHDDGSPTSKTFEHVMSEIGAEEAEEIGVEHLLRDIKDTTVGSLSQRVTNQLMGLKGLHLQLQDMRDYLNQVVEGKLPMNHQIVYQLQDIFNLLPDIGHGNFVDSLY

SEQ ID NO: 1087 - DNA, 363 bp, Nilaparvata lugens
tgcgactatgatcgaccgccgggacgcggtcaggtgtgcgacgtcgacgtcaagaactggtttccctgcacctctgagaacaatttcaactaccatcaatcgagcccttgtgtttttctcaaactgaacaagataattggttggcaaccggagtactacaatgagactgaaggctttccagataatatgccaggtgacctcaagcgacacattgcccaacagaagagtatcaacaagctgtttatgcaaacaatctggataacttgcgaaggagagggtcctctagacaaggagaatgcaggggagatccagtacatccctagacagggatttccgggctacttctacccttacactaatgcc

SEQ ID NO: 1088 - protein, 121 aa, Nilaparvata lugens
CDYDRPPGRGQVCDVDVKNWFPCTSENNFNYHQSSPCVFLKLNKIIGWQPEYYNETEGFPDNMPGDLKRHIAQQKSINKLFMQTIWITCEGEGPLDKENAGEIQYIPRQGFPGYFYPYTNA

SEQ ID NO: 1089 - DNA, 769 bp, Nilaparvata lugens
gtccagtcgactggaagccaccaggcttgttgttcccgttggatgtctgtatcaacctttgaaggagagacctgatctaccgcctgtacagtacgatccagttctttgtactaggaatacttgtcgtgcaattctgaatccattgtgccaagtcgactatcgagccaagctatgggtctgcaacttttgtttccagaggaatcctttcccccctcaatatgcagctatttcggagcagcatcaaccagcagaactgataccttcattttccaccatcgaatacatcattaccagagcgcaaacgatgccgccgatgttcgtgctggtggtggacacatgtctggacgacgaggagctgggagctttgaaggactcactgcagatgtcgctgtcgctgctgccgcccaatgcactcatcggtctcatcacgttcggcaaaatggtgcaggtgcacgagcttggctgcgacggctgctcgaagagctacgtgttccgtggcgtgaaggacctgactgccaagcagatccaggacatgttgggcattggcaagatggccgccgctccacagcccatgcaacagcgcattcccggcgccgctccctccgcacctgtcaacagatttcttcagcctgtcggaaagtgcgatatgagtttaactgatctgcttggggaattgcaaagagatccatggaatgtggctcagggcaagagacctctccgatctactggagttgcattgtccattgcagttggtctgctcgagtgcaca

SEQ ID NO: 1090 - protein, 256 aa, Nilaparvata lugens
SSRLEATRLVVPVGCLYQPLKERPDLPPVQYDPVLCTRNTCRAILNPLCQVDYRAKLWVCNFCFQRNPFPPQYAAISEQHQPAELIPSFSTIEYIITRAQTMPPMFVLVVDTCLDDEELGALKDSLQMSLSLLPPNALIGLITFGKMVQVHELGCDGCSKSYVFRGVKDLTAKQIQDMLGIGKMAAAPQPMQQRIPGAAPSAPVNRFLQPVGKCDMSLTDLLGELQRDPWNVAQGKRPLRSTGVALSIAVGLLECT

SEQ ID NO: 1091 - DNA, 527 bp, Nilaparvata lugens
agatggtggtaccggcaaaactacatttgtcaaacgacatcttaccggagaatttgaaaagaagtatgttgccacccttggagttgaagttcacccccttgtatttcacacaaacagaggtgtgattaggttcaatgtgtgggacacagctggccaggaaaagttcggtggacttcgtgatggatattacattcagggacaatgcgccatcattatgtttgacgtaacgtcaagagtcacctacaagaacgttcccaactggcacagagatttagtgagggtttgcgaaaacattcccattgtactatgcggcaacaaagtagacatcaaggacaggaaagtcaaggccaagagcatagtcttccataggaagaagaaccttcagtactacgacatcagtgcgaaaagcaactacaacttcgagaagccgttcctgtggttggcaaagaagctgatcggtgaccccaacctggagttcgtcgccatgcccgccctcctcccacccgaggtcacaatggacccccaat

SEQ ID NO: 1092 - protein, 176 aa, Nilaparvata lugens
  misc_feature (176)..(176): Xaa can be any naturally occurring amino acid
DGGTGKTTFVKRHLTGEFEKKYVATLGVEVHPLVFHTNRGVIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLAKKLIGDPNLEFVAMPALLPPEVTMDPQX

SEQ ID NO: 1093 - DNA, 169 bp, Nilaparvata lugens
gcagcagacgcaggcacaggtagacgaggttgtcgatataatgaaaacaaacgttgagaaagtattggagagggatcaaaaactatcagaattggatgatcgagcagatgctctacagcaaggcgcttcacagtttgaacagcaagctggcaaactcaagaggaaattc

SEQ ID NO: 1094 - protein, 56 aa, Nilaparvata lugens
QQTQAQVDEVVDIMKTNVEKVLERDQKLSELDDRADALQQGASQFEQQAGKLKRKF

SEQ ID NO: 1095 - DNA, 355 bp, Nilaparvata lugens
cgcagagcaagtctacatctcttcactggccttattgaaaatgcttaagcacggtcgcgccggtgttcccatggaagttatgggcctaatgctgggcgaatttgtagacgactacactgtgcgtgtcattgatgtattcgctatgccacagagtggaacgggagtgagtgtggaggctgtagacccggtgttccaagcgaagatgttggacatgctaaagcagacaggacggcccgagatggtggtgggctggtaccactcgcacccgggcttcggctgctggctgtcgggtgtcgacatcaacacgcaggagagcttcgagcaactatccaagagagccgttgccgtcgtcgtc

SEQ ID NO: 1096 - protein, 118 aa, Nilaparvata lugens
AEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQESFEQLSKRAVAVVV

SEQ ID NO: 1097 - DNA, 598 bp, Nilaparvata lugens
tttcattgagcaagaagccaatgagaaagccgaagagatcgatgccaaggccgaggaagaattcaacattgaaaagggaaggctcgtacagcaccagcgccttaaaatcatggagtactatgacaggaaagagaagcaggttgagctccagaaaaaaatccaatcgtcaaacatgctgaaccaagcgcgtctgaaggcactgaaggtgcgcgaagatcacgtgagaagtgtgctcgaagaatccagaaaacgtcttggagaagtaaccagaaacccagccaagtacaaggaagtcctccagtatctaattgtccaaggactcctgcagctgctagaatcaaacgtagtactgcgcgtgcgcgaggctgacgtgagtctgatcgagggcattgttggctcatgcgcagagcagtacgcgaagatgaccggcaaagaggtggtggtgaagctggacgctgacaacttcctggccgccgagacgtgtggaggcgtcgagttgttcgcccgcaacggccgcatcaagatccccaacaccctcgagtccaggctcgacctcatctcccagcaacttgtgcccgagattagagtcgcgctcttt

SEQ ID NO: 1098 - protein, 199 aa, Nilaparvata lugens
FIEQEANEKAEEIDAKAEEEFNIEKGRLVQHQRLKIMEYYDRKEKQVELQKKIQSSNMLNQARLKALKVREDHVRSVLEESRKRLGEVTRNPAKYKEVLQYLIVQGLLQLLESNVVLRVREADVSLIEGIVGSCAEQYAKMTGKEVVVKLDADNFLAAETCGGVELFARNGRIKIPNTLESRLDLISQQLVPEIRVALF

SEQ ID NO: 1099 - DNA, 986 bp, Nilaparvata lugens
attgtgctgtctgacgagacatgtccgttcgaaaagatccgcatgaatcgagtggtcaggaagaatctgcgagtgcgcttgtccgacattgtctcgatccagccttgcccagacgtcaagtatggaaagcgtatccatgtgctgcccattgatgataccgttgagggtcttacaggaaatctgttcgaagtgtatttgaagccatacttcctggaagcatacaggccaattcacaaggatgatgcattcattgttcgcggaggtatgagagcggtcgaattcaaggtggttgaaacagatccatcgccctactgcattgtcgcgccagacaccgtcatccattgtgagggagaccccatcaaacgtgaggatgaagaagacgcagcaaacgcagtcggctacgacgacattggaggctgcagaaagcagctggcgcagatcaaagagatggtggagttgccgctgagacatcccagtctgttcaaggcgatcggcgtgaagccgccacgaggcatcctgctgtacggaccaccgggaaccggaaagacgttgatagcgcgcgccgtcgccaacgaaacgggcgccttcttcttcctcatcaacggacccgagattatgagcaaattggccggcgagtcggagagtaacctgcgcaaagctttcgaggaagcggacaaaaacgcaccggccatcatcttcatcgatgagctggacgcaatcgcgccaaaacgcgagaagacgcacggcgaggtggagcgacgcatcgtgtcgcagctgctgacgctgatggacggtctcaagcagagctcgcacgtgattgtcatggccgccaccaatcggcccaactcgatcgatgccgcgcttaggcgctttggccgctttgatcgcgaaatcgacattggcattcccgatgccaccggtcgtctcgaggtgctgcgcatccacaccaagaacatgaagttggctgatgacgtcgatttggaaca

SEQ ID NO: 1100 - protein, 329 aa, Nilaparvata lugens
  misc_feature (329)..(329): Xaa can be any naturally occurring amino acid
IVLSDETCPFEKIRMNRVVRKNLRVRLSDIVSIQPCPDVKYGKRIHVLPIDDTVEGLTGNLFEVYLKPYFLEAYRPIHKDDAFIVRGGMRAVEFKVVETDPSPYCIVAPDTVIHCEGDPIKREDEEDAANAVGYDDIGGCRKQLAQIKEMVELPLRHPSLFKAIGVKPPRGILLYGPPGTGKTLIARAVANETGAFFFLINGPEIMSKLAGESESNLRKAFEEADKNAPAIIFIDELDAIAPKREKTHGEVERRIVSQLLTLMDGLKQSSHVIVMAATNRPNSIDAALRRFGRFDREIDIGIPDATGRLEVLRIHTKNMKLADDVDLEX

SEQ ID NO: 1101 - DNA, 691 bp, Nilaparvata lugens
gacgccagtatcagaagacatgcttggtcgtgtattcaacggaagtggtaagcccatcgacaaaggacctcccattcttgctgaggattatctcgacattcaaggtcaacccatcaatccttggtcgcgtatctatcccgaggaaatgatccagactggaatttcagccatcgacgtcatgaactcgattgctcgtggccagaaaatccccatcttttcagctgccggtctacctcacaacgaaattgctgctcaaatctgtagacaggctggtcttgtcaaactgccaggaaagtcagttctcgatgactctgaggacaactttgctattgtattcgcagccatgggagtcaacatggaaactgctcgattcttcaaacaggatttcgaggagaacggctctatggagaacgtgtgcctgttcttgaacctggcgaacgacccgacgatcgagcgtatcatcacaccacgcctggcgctgacggccgccgagttcctggcctaccagtgcgagaagcacgtgctcgtcatcctcaccgacatgagctcctacgccgaggcgctgcgagaggtgtccgccgcccgcgaggaggtgcccggccgtcgtggtttccccggttacatgtacaccgatctggccaccatctacgagcgcgccggacgagtcgagggtcgcaacggctccatcacg

SEQ ID NO: 1102 - protein, 230 aa, Nilaparvata lugens
TPVSEDMLGRVFNGSGKPIDKGPPILAEDYLDIQGQPINPWSRIYPEEMIQTGISAIDVMNSIARGQKIPIFSAAGLPHNEIAAQICRQAGLVKLPGKSVLDDSEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSIT

SEQ ID NO: 1103 - DNA, 1099 bp, Nilaparvata lugens
tatgcaaatgcctgtgccacgcccacaaatagaaagcacacaacagtttattcgatccgagaaaacaacatactcgaatggattcaccaccattgaggaggacttcaaagtagacactttcgaataccgtcttctgcgcgaggtgtcgttccgcgaatctctgatcagaaactacttgcacgaggcggacatgcagatgtcgacggtggtggaccgagcattgggtcccccctcggcgccacacatccagcagaagccgcgcaactcaaaaatccaggagggcggcgatgccgtcttttccatcaagctcagcgccaaccccaagcctcggctggtctggttcaagaacggtcagcgcatcggtcagacgcagaaacaccaggcctcctactccaatcagaccgccacgctcaaggtcaacaaagtcagcgctcaagactccggccactacacgctgcttgctgaaaatccgcaaggatgtactgtgtcctcagcttacctagctgtcgaatcagctggcactcaagatacaggatacagtgagcaatacagcagacaagaggtggagacgacagaggcggtggacagcagcaagatgctggcaccgaactttgttcgcgtgccggccgatcgcgacgcgagcgaaggcaagatgacgcggtttgactgccgcgtgacgggccgaccctacccggacgtggcctggttcatcaacggccaacaggtggctgacgacgccacgcacaagatcctcgtcaacgagtctggcaaccactcgctcatgatcaccggcgtcactcgcttggaccacggagtggtcggctgtattgcccgcaacaaggctggcgaaacctcattccagtgcaacttgaatgtgatcgagaaagaactggttgtggcgccgaaatttgtggagagattcgcacaagtgaatgtgaaggagggtgagccggttgtgctgagcgcacgcgctgttggcacacctgttccaagaataacatggcagaaggacggcgccccgatccagtcgggaccgagcgtgagtctgtttgtggacggaggtgcgaccagcctggacatcccgtacgcgaaggcgtcg

SEQ ID NO: 1104 - protein, 366 aa, Nilaparvata lugens
MQMPVPRPQIESTQQFIRSEKTTYSNGFTTIEEDFKVDTFEYRLLREVSFRESLIRNYLHEADMQMSTVVDRALGPPSAPHIQQKPRNSKIQEGGDAVFSIKLSANPKPRLVWFKNGQRIGQTQKHQASYSNQTATLKVNKVSAQDSGHYTLLAENPQGCTVSSAYLAVESAGTQDTGYSEQYSRQEVETTEAVDSSKMLAPNFVRVPADRDASEGKMTRFDCRVTGRPYPDVAWFINGQQVADDATHKILVNESGNHSLMITGVTRLDHGVVGCIARNKAGETSFQCNLNVIEKELVVAPKFVERFAQVNVKEGEPVVLSARAVGTPVPRITWQKDGAPIQSGPSVSLFVDGGATSLDIPYAKAS

SEQ ID NO: 1105 - DNA, 402 bp, Nilaparvata lugens
cgatgacacatacacagaaagttacatcagtaccattggtgtagattttaaaattagaacaatagatctcgatggaaaaaccataaagcttcagatttgggacacggccggccaggagcggttccgcacgatcacatcgagctactaccggggcgcccacggcatcattgtggtgtacgactgcaccgaccaggagtcgttcaacaacctcaaacagtggctcgaggagattgaccgctacgcctgtgataatgtcaacaaactgctcgtcggcaacaagtgtgatcagaccaacaaaaaggtcgtcgactatacacaggctaaggaatacgccgaccagctgggcattccgttcctggagacgtcggcgaagaacgcgaccaatgtggagcaggcgttcat

SEQ ID NO: 1106 - protein, 133 aa, Nilaparvata lugens
DDTYTESYISTIGVDFKIRTIDLDGKTIKLQIWDTAGQERFRTITSSYYRGAHGIIVVYDCTDQESFNNLKQWLEEIDRYACDNVNKLLVGNKCDQTNKKVVDYTQAKEYADQLGIPFLETSAKNATNVEQAF

SEQ ID NO: 1107 - DNA, 493 bp, Nilaparvata lugens
cgtcagtctcaattctgtcaccgatatcagcaccacgttcattctcaagccacaagagaacgtgaagataacgcttgagggcgcacaggcctgtttcatttcacacgaacgacttgtgatctcactgaagggaggagaactctatgttctaactctctattccgatagtatgcgcagtgtgaggagttttcatctggagaaagctgctgccagtgtcttgactacttgtatctgtgtttgtgaggagaactatctgttccttggttcccgtcttggaaactcactgttgctcaggtttactgagaaggaattgaacctgattgagccgagggccatcgaaagctcacagtcccagaatccggccaagaagaaaaagctggatactttgggagattggatggcatctgacgtcactgaaatacgcgacctggatgaactagaagtgtatggcagtgaaacacaaacctctatgcaaattgcatcctacatattc

SEQ ID NO: 1108 - protein, 164 aa, Nilaparvata lugens
VSLNSVTDISTTFILKPQENVKITLEGAQACFISHERLVISLKGGELYVLTLYSDSMRSVRSFHLEKAAASVLTTCICVCEENYLFLGSRLGNSLLLRFTEKELNLIEPRAIESSQSQNPAKKKKLDTLGDWMASDVTEIRDLDELEVYGSETQTSMQIASYIF

SEQ ID NO: 1109 - DNA, 721 bp, Nilaparvata lugens
tacattgcacagagaattcctttccgagccagatctgcaatcttacagtgttatgataattgatgaagctcacgagaggacgttgcacactgatatactgttcggtttggtgaaagatgtcgcccgattcagacctgacttgaagctgctcatatcaagcgccacactggatgctcagaaattctccgagtttttcgacgatgcacccatcttcaggattccgggccgtagatttccggtggacatctactacacaaaggcgcccgaggctgactacgtggacgcatgtgtcgtttcgatcctgcagatccacgccactcagccgctgggagacatcctggtcttcctcaccggtcaggaggagatcgaaacctgccaggagctgctgcaggacagagtgcgcaggcttgggcctcgtatcaaggagctgctcatattgcccgtctattccaacctacccagtgatatgcaggcaaagattttcctgcccactccaccaaatgctagaaaggtagtattggccacaaatattgcagaaacctcattgaccatcgacaatataatctacgtgattgatcctggtttttgtaagcagaataacttcaattcaaggactggaatggaatcgcttgttgtagtgcctgtttcaaaggcatcggccaatcagcgagcagggcgggcgggacgggtggcggccggcaagtgcttccgtctgtacacg

SEQ ID NO: 1110 - protein, 240 aa, Nilaparvata lugens
TLHREFLSEPDLQSYSVMIIDEAHERTLHTDILFGLVKDVARFRPDLKLLISSATLDAQKFSEFFDDAPIFRIPGRRFPVDIYYTKAPEADYVDACVVSILQIHATQPLGDILVFLTGQEEIETCQELLQDRVRRLGPRIKELLILPVYSNLPSDMQAKIFLPTPPNARKVVLATNIAETSLTIDNIIYVIDPGFCKQNNFNSRTGMESLVVVPVSKASANQRAGRAGRVAAGKCFRLYT

SEQ ID NO: 1111 - DNA, 1681 bp, Nilaparvata lugens
ccggagcttctctcaggaacgccagcacgaggaaatgaaggaatcctcgggtcgcatgcatcacagcgatcctctaatcgtcgagactcatagcggtcacgtgagaggaatctcgaagaccgtcctcggacgggaggtccacgtgtttaccgggattccgtttgcgaaacctcccatcggtccgttgcgattccgtaaaccggttcccgtcgacccgtggcacggcgttctggatgcgaccgcgcttcccaacagctgctaccaggaacggtacgagtatttcccgggcttcgagggagaggaaatgtggaatccgaatacgaatttgtccgaagattgtctgtatttgaacatatgggtgccgcaccggttgagaatccgacacagagccaacagcgaggagaataaaccaagagcgaaggtgccggtgctgatctggatctacggcgggggttacatgagcggcacagctacactggacgtgtacgatgctgacatggtggccgccacgagtgacgtcatcgtcgcctccatgcagtaccgagtgggtgcgttcggcttcctctacctcgcacaggacttgcctcgaggcagcgaggaggcgccgggcaacatggggctctgggaccaggcccttgccatccgctggctcaaggacaacattgccgccttcggaggcgatcccgaactcatgacgctctttggcgagtcggctgggggtggatctgtaagcatccacttggtatcaccgataactcgcggcctagcgcgtcgtggcatcatgcagtcaggaacgatgaacgcaccgtggagcttcatgacggcggaacgcgcgaccgaaatcgccaagacgctcattgacgactgcggctgcaactcgtcgctcctgaccgacgctcccagtcgcgtcatgtcctgtatgcgatcagtcgaggcaaagatcatctccgtgcagcaatggaacagctactccggcattctcggacttccgtctgcacccaccatcgacggcattttcctgcccaaacatcccctcgatctgctcaaggaaggcgactttcaggacactgaaatactcatcggcagtaatcaggatgagggtacctacttcatattgtacgatttcatcgacttcttccaaaaagacgggccgagtttcttgcaaagagataagttcctagacatcatcaacacaattttcaagaatatgacgaaaattgagagggaagctatcatattccagtacacagattgggagcatgttatggatggttatctgaaccagaaaatgatcggagatgtggttggtgattacttcttcatctgtccgacaaatcatttcgcacaggcattcgcagagcatggaaagaaggtgtattactatttcttcacccagagaaccagtacaagtttatggggcgagtggatgggagtcatgcatggagatgaaatagaatacgtttttggtcatcctctcaacatgtcgctgcaattcaatgctagggaaagggatctcagtctgcgaataatgcaagcttactctaggtttgcattgacaggtaaaccagtgcctgatgacgtgaattggcctatctactccaaggaccagccgcagtattacattttcaatgcggagacttcgggcacaggcagaggacccagagcaacagcgtgtgctttc

SEQ ID NO: 1112 - protein, 560 aa, Nilaparvata lugens
RSFSQERQHEEMKESSGRMHHSDPLIVETHSGHVRGISKTVLGREVHVFTGIPFAKPPIGPLRFRKPVPVDPWHGVLDATALPNSCYQERYEYFPGFEGEEMWNPNTNLSEDCLYLNIWVPHRLRIRHRANSEENKPRAKVPVLIWIYGGGYMSGTATLDVYDADMVAATSDVIVASMQYRVGAFGFLYLAQDLPRGSEEAPGNMGLWDQALAIRWLKDNIAAFGGDPELMTLFGESAGGGSVSIHLVSPITRGLARRGIMQSGTMNAPWSFMTAERATEIAKTLIDDCGCNSSLLTDAPSRVMSCMRSVEAKIISVQQWNSYSGILGLPSAPTIDGIFLPKHPLDLLKEGDFQDTEILIGSNQDEGTYFILYDFIDFFQKDGPSFLQRDKFLDIINTIFKNMTKIEREAIIFQYTDWEHVMDGYLNQKMIGDVVGDYFFICPTNHFAQAFAEHGKKVYYYFFTQRTSTSLWGEWMGVMHGDEIEYVFGHPLNMSLQFNARERDLSLRIMQAYSRFALTGKPVPDDVNWPIYSKDQPQYYIFNAETSGTGRGPRATACAF

SEQ ID NO: 1113 - DNA, 850 bp, Nilaparvata lugens
agaagacggcacggtgcgtatttggcactcgggcacctacaggctggagtcctcgctgaattatggcctcgaaagagtgtggaccatttgctgcatgcgaggatccaacaatgtggctcttggctacgacgaaggcagcataatggtgaaggtgggtcgggaggagccggccatctcgatggatgtgaacggtgagaagattgtgtgggcgcgccactcggagatacaacaggtcaacctcaaggccatgccggagggcgtcgaaatcaaagatggcgaacgactgccggtcgccgttaaggatatgggcagctgtgaaatatatccgcagaccatcgctcataatcccaacggcagattcctagtcgtttgtggagatggagagtacataattcacacatcaatggtgctaagaaataaggcgtttggctcggcccaagagttcatttggggacaggactcgtccgagtatgctatcagagaaggaacatccactgtcaaagtattcaaaaacttcaaagaaaagaaatcattcaagccagaatttggtgctgagagcatattcggcggctacctgctgggagtttgttcgttgtctggactggcgctgtacgactgggagaccctggagctggtgcgtcgcatcgagatccaaccgaaacacgtgtactggtcggagagtggggagctggtggcgctggccactgatgactcctactttgtgctccgctacgacgcacaggccgtgctcgctgcacgcgacgccggtgacgacgctgtcacgccggacggcgtcgaggatgcattcgaggtccttggtgaagtgcacgaaactgtaaaaactggattg

SEQ ID NO: 1114 - protein, 299 aa, Nilaparvata lugens
PIVLTGSEDGTVRIWHSGTYRLESSLNYGLERVWTICCMRGSNNVALGYDEGSIMVKVGREEPAISMDVNGEKIVWARHSEIQQVNLKAMPEGVEIKDGERLPVAVKDMGSCEIYPQTIAHNPNGRFLVVCGDGEYIIHTSMVLRNKAFGSAQEFIWGQDSSEYAIREGTSTVKVFKNFKEKKSFKPEFGAESIFGGYLLGVCSLSGLALYDWETLELVRRIEIQPKHVYWSESGELVALATDDSYFVLRYDAQAVLAARDAGDDAVTPDGVEDAFEVLGEVHETVKTGLWVGDCFIYT

SEQ ID NO: 1115 - DNA, 751 bp, Nilaparvata lugens
cgttgaacgtgaaaggctcgtgtgtgtcagacactgacattggcttgggcggcacctctcaatggaaaatgtgcgccttcactccacacacaacttgtgcattcttcttcgaagttgtcaaccagcacgcagccccaatcccacagggaggaagaggatgcatccaattcattacgcaataccaacattccagtggccagagaaggatacgtgtcaccaccatcgctcgaaactgggcagatgcgagcaccaacctggcacacatcagtgccggcttcgaccaggaggcaggagccgtgctgatggcccgcatggtcgtgcatcgcgccgagactgacgatggacctgacgtcatgcgctgggctgaccgcatgctcatccgtctctgtcagaggttcggtgaatacagtaaggatgaccctaacagtttccgtctgccagagaacttcacactttatccgcagttcatgtaccatctgcgtcgatcccaattcttgcaagtgttcaacaacagtcctgatgaaacatcttactacaggcacattcttatgcgagaggatctgactcagagtttgattatgatccagccgattttgtacagctacagcttcaatggtccccccgagccagtgctgctcgacaccagcagtattcaacccgacagaatcctattgatggacacatttttccaaattctcattttccatggagagacgattgctcaatggcgatctctgggctaccaggacat

SEQ ID NO: 1116 - protein, 240 aa, Nilaparvata lugens
LNVKGSCVSDTDIGLGGTSQWKMCAFTPHTTCAFFFEVVNQHAAPIPQGGRGCIQFITQYQHSSGQRRIRVTTIARNWADASTNLAHISAGFDQEAGAVLMARMVVHRAETDDGPDVMRWADRMLIRLCQRFGEYSKDDPNSFRLPENFTLYPQFMYHLRRSQFLQVFNNSPDETSYYRHILMREDLTQSLIMIQPILYSYSFNGPPEPVLLDTSSIQPDRILLMDTFFQILIFHGETIA

SEQ ID NO: 1117 - DNA, 26 bp, artificial sequence
  Description of artificial sequence:  synthetic primer
gaaatcatggatgttggacaaattgg

SEQ ID NO: 1118 - DNA, 22 bp, artificial sequence
  Description of artificial sequence:  synthetic primer
actgagcttcacacccttgccc

SEQ ID NO: 1119 - DNA, 24 bp, artificial sequence
  Description of artificial sequence:  synthetic primer
gatgaaaagggccctacaactggc

SEQ ID NO: 1120 - DNA, 26 bp, artificial sequence
  Description of artificial sequence:  synthetic primer
ctgatccacatccatgtgttgatgag

SEQ ID NO: 1121 - DNA, 24 bp, artificial sequence
  Description of artificial sequence:  synthetic primer
tccgcgtcgtccttacgagaaggc

SEQ ID NO: 1122 - DNA, 22 bp, artificial sequence
  Description of artificial sequence:  synthetic primer
ttgacgcgaccaggtcggccac

SEQ ID NO: 1123 - DNA, 28 bp, artificial sequence
  Description of artificial sequence:  synthetic primer
tgaaggtggagaarggttyggmwcmaag

SEQ ID NO: 1124 - DNA, 26 bp, artificial sequence
  Description of artificial sequence:  synthetic primer
gtcgtcttctcdgahacrtavagacc

SEQ ID NO: 1125 - DNA, 30 bp, artificial sequence; identical to SEQ ID NO: 613
  Description of artificial sequence:  synthetic primer

SEQ ID NO: 1126 - DNA, 26 bp, artificial sequence
  Description of artificial sequence:  synthetic primer
tcctgcttcttsgyrgcratwcgytc

SEQ ID NO: 1127 - DNA, 29 bp, artificial sequence
  Description of artificial sequence:  synthetic primer
ggagcgagactacaacaaykayrgytggc

SEQ ID NO: 1128 - DNA, 26 bp, artificial sequence
  Description of artificial sequence:  synthetic primer
gagatcttctgcacrttkacvgcatc

SEQ ID NO: 1129 - DNA, 22 bp, artificial sequence
  Description of artificial sequence:  synthetic primer
cggtgtccattcacagytccgg

SEQ ID NO: 1130 - DNA, 26 bp, artificial sequence
  Description of artificial sequence:  synthetic primer
cgatgcaagtaggtgtckgartcytc

SEQ ID NO: 1131 - DNA, 24 bp, artificial sequence
  Description of artificial sequence:  synthetic primer
gtggtggatcacttyaaycgkatg

SEQ ID NO: 1132 - DNA, 24 bp, artificial sequence
  Description of artificial sequence:  synthetic primer
gcgcatttgatcgttbgtyttcac

SEQ ID NO: 1133 - DNA, 25 bp, artificial sequence
  Description of artificial sequence:  synthetic primer
gggccgtggtcagaayatywayaac

SEQ ID NO: 1134 - DNA, 25 bp, artificial sequence
  Description of artificial sequence:  synthetic primer
ccgccaaaggactsarrtadccctc

SEQ ID NO: 1135 - DNA, 23 bp, artificial sequence
  Description of artificial sequence:  synthetic primer
cggctgacgtggaaygtktggcc

SEQ ID NO: 1136 - DNA, 24 bp, artificial sequence
  Description of artificial sequence:  synthetic primer
tgccggaagttctcrtaytckggc

SEQ ID NO: 1137 - DNA, 26 bp, artificial sequence
  Description of artificial sequence:  synthetic primer
cccactttcaagtgygtrytrgtcgg

SEQ ID NO: 1138 - DNA, 25 bp, artificial sequence
  Description of artificial sequence:  synthetic primer
cgctctctctcgatctgydsctgcc

SEQ ID NO: 1139 - DNA, 21 bp, artificial sequence
  Description of artificial sequence:  synthetic primer
gcaggcgcaggtbgabgargt

SEQ ID NO: 1140 - DNA, 24 bp, artificial sequence
  Description of artificial sequence:  synthetic primer
gaatttcctcttsagyttbccvgc

SEQ ID NO: 1141 - DNA, 22 bp, artificial sequence
  Description of artificial sequence:  synthetic primer
cagatgcgcccgtbgtdgayac

SEQ ID NO: 1142 - DNA, 24 bp, artificial sequence
  Description of artificial sequence:  synthetic primer
gcccttgacagaytgdatvggatc

SEQ ID NO: 1143 - DNA, 24 bp, artificial sequence
  Description of artificial sequence:  synthetic primer
gcccttgacagaytgdatvggatc

SEQ ID NO: 1144 - DNA, 24 bp, artificial sequence
  Description of artificial sequence:  synthetic primer
gaacttgcggttgabgttscgdcc

SEQ ID NO: 1145 - DNA, 20 bp, artificial sequence
  Description of artificial sequence:  synthetic primer
gccgcaaggagacbgtvtgc

SEQ ID NO: 1146 - DNA, 23 bp, artificial sequence
  Description of artificial sequence:  synthetic primer
gtccgtgggaytcrgchgcaatc

SEQ ID NO: 1147 - DNA, 21 bp, artificial sequence
  Description of artificial sequence:  synthetic primer
gttcaccggcgayatyctgcg

SEQ ID NO: 1148 - DNA, 24 bp, artificial sequence
  Description of artificial sequence:  synthetic primer
cggcatagtcagaatsggratctg

SEQ ID NO: 1149 - DNA, 25 bp, artificial sequence
  Description of artificial sequence:  synthetic primer
  misc_feature (20)..(20): n is a, c, g, or t
gctccgtctacathcarccngargg

SEQ ID NO: 1150 - DNA, 23 bp, artificial sequence
  Description of artificial sequence:  synthetic primer
gtgcatcggtaccahschgcrtc

SEQ ID NO: 1151 - DNA, 24 bp, artificial sequence
  Description of artificial sequence:  synthetic primer
gtcctgtctgctgctvmgwttygc

SEQ ID NO: 1152 - DNA, 23 bp, artificial sequence
  Description of artificial sequence:  synthetic primer
ccttgatctchgcmgccatbgtc

SEQ ID NO: 1153 - DNA, 26 bp, artificial sequence
  Description of artificial sequence:  synthetic primer
ctcaatcagagcgtycchccrtaygg

SEQ ID NO: 1154 - DNA, 21 bp, artificial sequence
  Description of artificial sequence:  synthetic primer
ggaattgccsagvcgdgadcc

SEQ ID NO: 1155 - DNA, 25 bp, artificial sequence
  Description of artificial sequence:  synthetic primer
gcgtgctcaagtayatgacbgaygg

SEQ ID NO: 1156 - DNA, 25 bp, artificial sequence
  Description of artificial sequence:  synthetic primer
  misc_feature (17)..(17): n is a, c, g, or t
  misc_feature (23)..(23): n is a, c, g, or t
ccagttcatgcttrtangcccangc

SEQ ID NO: 1157 - DNA, 22 bp, artificial sequence
  Description of artificial sequence:  synthetic primer
ccggagcttctctcaggaacgc

SEQ ID NO: 1158 - DNA, 23 bp, artificial sequence
  Description of artificial sequence:  synthetic primer
gaaagcacacgctgttgctctgg

SEQ ID NO: 1159 - DNA, 21 bp, artificial sequence
  Description of artificial sequence:  synthetic primer
gccgatcgtkytvackggctc

SEQ ID NO: 1160 - DNA, 27 bp, artificial sequence
  Description of artificial sequence:  synthetic primer
ggtatagatgaarcartcdccvaccca

SEQ ID NO: 1161 - DNA, 22 bp, Nilaparvata lugens
ctgaagaagctaagtacaagct

SEQ ID NO: 1162 - DNA, 26 bp, Nilaparvata lugens
ttcttccgtttgatctatgatgttaa

SEQ ID NO: 1163 - DNA, 22 bp, Nilaparvata lugens
cagctgaagaagctaagtacaa

SEQ ID NO: 1164 - DNA, 29 bp, Nilaparvata lugens
gagttcttccgtttgatctatgatgttaa

SEQ ID NO: 1165 - DNA, 24 bp, Nilaparvata lugens
aagtacaagctgtgcaaagtgaag

SEQ ID NO: 1166 - DNA, 24 bp, Nilaparvata lugens
ttcgacatcgtgcacatcaaggac

SEQ ID NO: 1167 - DNA, 27 bp, Nilaparvata lugens
atcacagctgaagaagctaagtacaag

SEQ ID NO: 1168 - DNA, 25 bp, Nilaparvata lugens
tgtgtatgatcactggaggtcgtaa

SEQ ID NO: 1169 - DNA, 21 bp, Nilaparvata lugens
aacgttttcatcatcggcaag

SEQ ID NO: 1170 - DNA, 21 bp, Nilaparvata lugens
ccaaaatcatggacttcatca

SEQ ID NO: 1171 - DNA, 22 bp, Nilaparvata lugens
tgatctatgatgttaagggacg

SEQ ID NO: 1172 - DNA, 22 bp, Nilaparvata lugens
catggatgttggacaaattggg

SEQ ID NO: 1173 - DNA, 24 bp, Nilaparvata lugens
ttttgccactaggttgaacaacgt

SEQ ID NO: 1174 - DNA, 27 bp, Nilaparvata lugens
gcagcgtctcatcaaggttgacggcaa

SEQ ID NO: 1175 - DNA, 21 bp, Nilaparvata lugens
aagggacgtttcaccatccac

SEQ ID NO: 1176 - DNA, 23 bp, Nilaparvata lugens
aacctgtgtatgatcactggagg

SEQ ID NO: 1177 - DNA, 26 bp, Nilaparvata lugens
actaactgtgaagtgaagaaaattgt

SEQ ID NO: 1178 - DNA, 23 bp, Nilaparvata lugens
ttcttccgtttgatctatgatgt

SEQ ID NO: 1179 - DNA, 29 bp, Nilaparvata lugens
tgtatgatcactggaggtcgtaacttggg

SEQ ID NO: 1180 - DNA, 25 bp, Nilaparvata lugens
catggatgttggacaaattgggtgg

SEQ ID NO: 1181 - DNA, 21 bp, Nilaparvata lugens
gctgaagaagctaagtacaag

SEQ ID NO: 1182 - DNA, 23 bp, Nilaparvata lugens
ggaggtcgtaacttgggtcgtgt

SEQ ID NO: 1183 - DNA, 26 bp, Nilaparvata lugens
tatgatgttaagggacgtttcaccat

SEQ ID NO: 1184 - DNA, 22 bp, Nilaparvata lugens
catggatgttggacaaattggg

SEQ ID NO: 1185 - DNA, 22 bp, Nilaparvata lugens
ctgaagaagctaagtacaagct

SEQ ID NO: 1186 - DNA, 23 bp, Nilaparvata lugens
gaagaagctaagtacaagctgtg

SEQ ID NO: 1187 - DNA, 26 bp, Nilaparvata lugens
ttgcacagcttgtacttagcttcttc

SEQ ID NO: 1188 - DNA, 24 bp, Nilaparvata lugens
aagtacaagctgtgcaaagtgaag

SEQ ID NO: 1189 - DNA, 29 bp, Nilaparvata lugens
atgatcactggaggtcgtaacttgggtcg

SEQ ID NO: 1190 - DNA, 23 bp, Nilaparvata lugens
ggtcgtaacttgggtcgtgtggg

SEQ ID NO: 1191 - DNA, 24 bp, Nilaparvata lugens
ttcgacatcgtgcacatcaaggac

SEQ ID NO: 1192 - DNA, 21 bp, Nilaparvata lugens
acatcgtgcacatcaaggacg

SEQ ID NO: 1193 - DNA, 29 bp, Nilaparvata lugens
caggagttgaagatcatcggagagtatgg

SEQ ID NO: 1194 - DNA, 21 bp, Nilaparvata lugens
cgtaaggccgctcgtgagctg

SEQ ID NO: 1195 - DNA, 22 bp, Nilaparvata lugens
aaggtaacgccctgctgcgtcg

SEQ ID NO: 1196 - DNA, 26 bp, Nilaparvata lugens
caggagttgaagatcatcggagagta

SEQ ID NO: 1197 - DNA, 23 bp, Nilaparvata lugens
gccaagtccatccatcacgcccg

SEQ ID NO: 1198 - DNA, 21 bp, Nilaparvata lugens
aagtccatccatcacgcccgt

SEQ ID NO: 1199 - DNA, 22 bp, Nilaparvata lugens
tgtttgaaggtaacgccctgct

SEQ ID NO: 1200 - DNA, 23 bp, Nilaparvata lugens
caggagttgaagatcatcggaga

SEQ ID NO: 1201 - DNA, 26 bp, Nilaparvata lugens
gtgcgcctggactcgcagaagcacat

SEQ ID NO: 1202 - DNA, 23 bp, Nilaparvata lugens
gagttgaagatcatcggagagta

SEQ ID NO: 1203 - DNA, 24 bp, Nilaparvata lugens
ttgggtttaaaaattgaagatttc

SEQ ID NO: 1204 - DNA, 23 bp, Nilaparvata lugens
tcgcagaagcacattgacttctc

SEQ ID NO: 1205 - DNA, 21 bp, Nilaparvata lugens
agaatgaagctcgattacgtc

SEQ ID NO: 1206 - DNA, 21 bp, Nilaparvata lugens
tttgtggtgcgcctggactcg

SEQ ID NO: 1207 - DNA, 28 bp, Nilaparvata lugens
agaagcacattgacttctcgctgaagtc

SEQ ID NO: 1208 - DNA, 26 bp, Nilaparvata lugens
tcgcagaagcacattgacttctcgct

SEQ ID NO: 1209 - DNA, 26 bp, Nilaparvata lugens
ctcatcagacaaagacatatcagagt

SEQ ID NO: 1210 - DNA, 23 bp, Nilaparvata lugens
ttgaagatcatcggagagtatgg

SEQ ID NO: 1211 - DNA, 21 bp, Nilaparvata lugens
aaaattgaagatttccttgaa

SEQ ID NO: 1212 - DNA, 23 bp, Nilaparvata lugens
cagaagcacattgacttctcgct

SEQ ID NO: 1213 - DNA, 21 bp, Nilaparvata lugens
cgtaaggccgctcgtgagctg

SEQ ID NO: 1214 - DNA, 23 bp, Nilaparvata lugens
gcgtgatggatggacttggccaa

SEQ ID NO: 1215 - DNA, 23 bp, Nilaparvata lugens
gccaagtccatccatcacgcccg

SEQ ID NO: 1216 - DNA, 24 bp, Nilaparvata lugens
gccaagtccatccatcacgcccgt

SEQ ID NO: 1217 - DNA, 26 bp, Nilaparvata lugens
ctcatcagacaaagacatatcagagt

SEQ ID NO: 1218 - DNA, 23 bp, Nilaparvata lugens
caggagttgaagatcatcggaga

SEQ ID NO: 1219 - DNA, 29 bp, Nilaparvata lugens
caggagttgaagatcatcggagagtatgg

SEQ ID NO: 1220 - DNA, 23 bp, Nilaparvata lugens
gagttgaagatcatcggagagta

SEQ ID NO: 1221 - DNA, 23 bp, Nilaparvata lugens
tcgcagaagcacattgacttctc

SEQ ID NO: 1222 - DNA, 23 bp, Nilaparvata lugens
ttgaagatcatcggagagtatgg

SEQ ID NO: 1223 - DNA, 26 bp, Nilaparvata lugens
cagaagcacattgacttctcgctgaa

SEQ ID NO: 1224 - DNA, 24 bp, Nilaparvata lugens
ctccgtaacaagcgtgaggtgtgg

SEQ ID NO: 1225 - DNA, 21 bp, Nilaparvata lugens
cgtaacaagcgtgaggtgtgg

SEQ ID NO: 1226 - DNA, 23 bp, Nilaparvata lugens
gtcaaatacgccctggccaagat

SEQ ID NO: 1227 - DNA, 26 bp, Nilaparvata lugens
tacgcccatttccccatcaactgtgt

SEQ ID NO: 1228 - DNA, 21 bp, Nilaparvata lugens
tgctctcacatcgaaaacatg

SEQ ID NO: 1229 - DNA, 24 bp, Nilaparvata lugens
aacttcctgggcgagaagtacatc

SEQ ID NO: 1230 - DNA, 29 bp, Nilaparvata lugens
gccgtgtacgcccatttccccatcaactg

SEQ ID NO: 1231 - DNA, 32 bp, Nilaparvata lugens
gtgtacgcccatttccccatcaactgtgtgac

SEQ ID NO: 1232 - DNA, 29 bp, Nilaparvata lugens
gtgtacgcccatttccccatcaactgtgt

SEQ ID NO: 1233 - DNA, 23 bp, Nilaparvata lugens
atgcgtgccgtgtacgcccattt

SEQ ID NO: 1234 - DNA, 23 bp, Nilaparvata lugens
tcagctgccctcatccaacagtc

SEQ ID NO: 1235 - DNA, 23 bp, Nilaparvata lugens
aaggatattcgtaaattcttgga

SEQ ID NO: 1236 - DNA, 23 bp, Nilaparvata lugens
gcccatttccccatcaactgtgt

SEQ ID NO: 1237 - DNA, 23 bp, Nilaparvata lugens
aacttcctgggcgagaagtacat

SEQ ID NO: 1238 - DNA, 29 bp, Nilaparvata lugens
aagaacaaggatattcgtaaattcttgga

SEQ ID NO: 1239 - DNA, 26 bp, Nilaparvata lugens
aacttcctgggcgagaagtacatccg

SEQ ID NO: 1240 - DNA, 23 bp, Nilaparvata lugens
catttccccatcaactgtgtgac

SEQ ID NO: 1241 - DNA, 29 bp, Nilaparvata lugens
cgtaacttcctgggcgagaagtacatccg

SEQ ID NO: 1242 - DNA, 23 bp, Nilaparvata lugens
agatcagctgccctcatccaaca

SEQ ID NO: 1243 - DNA, 29 bp, Nilaparvata lugens
gtgtacgcccatttccccatcaactgtgt

SEQ ID NO: 1244 - DNA, 24 bp, Nilaparvata lugens
tacgcccatttccccatcaactgt

SEQ ID NO: 1245 - DNA, 26 bp, Nilaparvata lugens
tacgcccatttccccatcaactgtgt

SEQ ID NO: 1246 - DNA, 23 bp, Nilaparvata lugens
gcccatttccccatcaactgtgt

SEQ ID NO: 1247 - DNA, 23 bp, Nilaparvata lugens
acacagttgatggggaaatgggc

SEQ ID NO: 1248 - DNA, 23 bp, Nilaparvata lugens
gcccatttccccatcaactgtgt

SEQ ID NO: 1249 - DNA, 26 bp, Nilaparvata lugens
gtcacacagttgatggggaaatgggc

SEQ ID NO: 1250 - DNA, 21 bp, Nilaparvata lugens
ccatttccccatcaactgtgt

SEQ ID NO: 1251 - DNA, 26 bp, Nilaparvata lugens
aagggtaacgtattcaagaacaagcg

SEQ ID NO: 1252 - DNA, 24 bp, Nilaparvata lugens
aagggtaacgtattcaagaacaag

SEQ ID NO: 1253 - DNA, 23 bp, Nilaparvata lugens
cgtgtattgatggagttcattca

SEQ ID NO: 1254 - DNA, 22 bp, Nilaparvata lugens
aaaggtcaaggaggccaagaag

SEQ ID NO: 1255 - DNA, 26 bp, Nilaparvata lugens
aagatgttgaacgaccaggctgaagc

SEQ ID NO: 1256 - DNA, 23 bp, Nilaparvata lugens
acgttacccttagccttcatgta

SEQ ID NO: 1257 - DNA, 26 bp, Nilaparvata lugens
aagggtaacgtattcaagaacaagcg

SEQ ID NO: 1258 - DNA, 23 bp, Nilaparvata lugens
cgtgtattgatggagttcattca

SEQ ID NO: 1259 - DNA, 21 bp, Nilaparvata lugens
aggtcaaggaggccaagaagc

SEQ ID NO: 1260 - DNA, 23 bp, Nilaparvata lugens
acgttacccttagccttcatgta

SEQ ID NO: 1261 - DNA, 26 bp, Nilaparvata lugens
aagggtaacgtattcaagaacaagcg

SEQ ID NO: 1262 - DNA, 21 bp, Nilaparvata lugens
agtcccaggaacacctatcag

SEQ ID NO: 1263 - DNA, 23 bp, Nilaparvata lugens
attattcccttccccgatcacaa

SEQ ID NO: 1264 - DNA, 29 bp, Nilaparvata lugens
cacgctatcccatctcgtatgacaattgg

SEQ ID NO: 1265 - DNA, 23 bp, Nilaparvata lugens
tacaagttctgcaaaattcgagt

SEQ ID NO: 1266 - DNA, 26 bp, Nilaparvata lugens
atgacaattggccatttaattgaatg

SEQ ID NO: 1267 - DNA, 23 bp, Nilaparvata lugens
acctacacgcactgcgagatcca

SEQ ID NO: 1268 - DNA, 23 bp, Nilaparvata lugens
ggtgtggtggagtacattgacac

SEQ ID NO: 1269 - DNA, 23 bp, Nilaparvata lugens
attattcccttccccgatcacaa

SEQ ID NO: 1270 - DNA, 21 bp, Nilaparvata lugens
agtcccaggaacacctatcag

SEQ ID NO: 1271 - DNA, 29 bp, Nilaparvata lugens
cacgctatcccatctcgtatgacaattgg

SEQ ID NO: 1272 - DNA, 23 bp, Nilaparvata lugens
tctcgtatgacaattggccattt

SEQ ID NO: 1273 - DNA, 22 bp, Nilaparvata lugens
gcaaacaagtcatgatgttcag

SEQ ID NO: 1274 - DNA, 29 bp, Nilaparvata lugens
ggtatgggaaaaactgctgtatttgtgtt

SEQ ID NO: 1275 - DNA, 21 bp, Nilaparvata lugens
gaatgcattcctcaagctgta

SEQ ID NO: 1276 - DNA, 23 bp, Nilaparvata lugens
tgcaagaaattcatgcaagatcc

SEQ ID NO: 1277 - DNA, 23 bp, Nilaparvata lugens
ttccaaatcagcaaagagtatga

SEQ ID NO: 1278 - DNA, 23 bp, Nilaparvata lugens
gatgacgaggccaagctgacgct

SEQ ID NO: 1279 - DNA, 32 bp, Nilaparvata lugens
tgtggttttgaacatccatctgaagtacaaca

SEQ ID NO: 1280 - DNA, 21 bp, Nilaparvata lugens
gaaaacgaaaagaacaaaaag

SEQ ID NO: 1281 - DNA, 29 bp, Nilaparvata lugens
ggtatgggaaaaactgctgtatttgtgtt

SEQ ID NO: 1282 - DNA, 22 bp, Nilaparvata lugens
gcaaacaagtcatgatgttcag

SEQ ID NO: 1283 - DNA, 26 bp, Nilaparvata lugens
ctgcagcagcactatgtcaaactcaa

SEQ ID NO: 1284 - DNA, 21 bp, Nilaparvata lugens
gaaaacgaaaagaacaaaaag

SEQ ID NO: 1285 - DNA, 21 bp, Nilaparvata lugens
tgccaagcctaaagatttggg

SEQ ID NO: 1286 - DNA, 26 bp, Nilaparvata lugens
atgttcaagaaagttaatgctagaga

SEQ ID NO: 1287 - DNA, 25 bp, Nilaparvata lugens
gagttgttggtgttcttttgggatg

SEQ ID NO: 1288 - DNA, 22 bp, Nilaparvata lugens
tttcaaacagttttgcagttcc

SEQ ID NO: 1289 - DNA, 25 bp, Nilaparvata lugens
gagttgttggtgttcttttgggatg

SEQ ID NO: 1290 - DNA, 21 bp, Nilaparvata lugens
aaggacctgactgccaagcag

SEQ ID NO: 1291 - DNA, 21 bp, Nilaparvata lugens
gccaagcagatccaggacatg

SEQ ID NO: 1292 - DNA, 23 bp, Nilaparvata lugens
tgctcgaagagctacgtgttccg

SEQ ID NO: 1293 - DNA, 21 bp, Nilaparvata lugens
aagagctacgtgttccgtggc

SEQ ID NO: 1294 - DNA, 21 bp, Nilaparvata lugens
aaggacctgactgccaagcag

SEQ ID NO: 1295 - DNA, 26 bp, Nilaparvata lugens
atggacacatttttccaaattctcat

SEQ ID NO: 1296 - DNA, 22 bp, Nilaparvata lugens
accagcagtattcaacccgaca

SEQ ID NO: 1297 - DNA, 22 bp, Nilaparvata lugens
tattgatggacacatttttcca

SEQ ID NO: 1298 - DNA, 23 bp, Nilaparvata lugens
ttcaacaacagtcctgatgaaac

SEQ ID NO: 1299 - DNA, 21 bp, Nilaparvata lugens
atggacacatttttccaaatt

SEQ ID NO: 1300 - DNA, 23 bp, Nilaparvata lugens
ccgcagttcatgtaccatctgcg

SEQ ID NO: 1301 - DNA, 21 bp, Nilaparvata lugens
atggacacatttttccaaatt

SEQ ID NO: 1302 - DNA, 23 bp, Nilaparvata lugens
aagaagtatgttgccacccttgg

SEQ ID NO: 1303 - DNA, 38 bp, Nilaparvata lugens
gacatcaaggacaggaaagtcaaggccaagagcatagt

SEQ ID NO: 1304 - DNA, 31 bp, Nilaparvata lugens
caactacaacttcgagaagccgttcctgtgg

SEQ ID NO: 1305 - DNA, 23 bp, Nilaparvata lugens
tacaagaacgttcccaactggca

SEQ ID NO: 1306 - DNA, 23 bp, Nilaparvata lugens
tgcgaaaacattcccattgtact

SEQ ID NO: 1307 - DNA, 26 bp, Nilaparvata lugens
aggaagaagaaccttcagtactacga

SEQ ID NO: 1308 - DNA, 23 bp, Nilaparvata lugens
agcaactacaacttcgagaagcc

SEQ ID NO: 1309 - DNA, 32 bp, Nilaparvata lugens
aacaaagtagacatcaaggacaggaaagtcaa

SEQ ID NO: 1310 - DNA, 24 bp, Nilaparvata lugens
cccaactggcacagagatttagtg

SEQ ID NO: 1311 - DNA, 23 bp, Nilaparvata lugens
gatggtggtaccggcaaaactac

SEQ ID NO: 1312 - DNA, 24 bp, Nilaparvata lugens
tacaagaacgttcccaactggcac

SEQ ID NO: 1313 - DNA, 32 bp, Nilaparvata lugens; identical to SEQ ID NO: 1309

SEQ ID NO: 1314 - DNA, 23 bp, Nilaparvata lugens
ttgactttcctgtccttgatgtc

SEQ ID NO: 1315 - DNA, 26 bp, Nilaparvata lugens
gacatcaaggacaggaaagtcaaggc

SEQ ID NO: 1316 - DNA, 26 bp, Nilaparvata lugens
aggaagaagaaccttcagtactacga

SEQ ID NO: 1317 - DNA, 24 bp, Nilaparvata lugens
gatgtcgtagtactgaaggttctt

SEQ ID NO: 1318 - DNA, 31 bp, Nilaparvata lugens; identical to SEQ ID NO: 1304

SEQ ID NO: 1319 - DNA, 25 bp, Nilaparvata lugens
ccaacctggagttcgtcgccatgcc

SEQ ID NO: 1320 - DNA, 23 bp, Nilaparvata lugens
gaatttgaaaagaagtatgttgc

SEQ ID NO: 1321 - DNA, 26 bp, Nilaparvata lugens
cttcagtactacgacatcagtgcgaa

SEQ ID NO: 1322 - DNA, 23 bp, Nilaparvata lugens
agcaactacaacttcgagaagcc

SEQ ID NO: 1323 - DNA, 29 bp, Nilaparvata lugens
aagctgatcggtgaccccaacctggagtt

SEQ ID NO: 1324 - DNA, 22 bp, Nilaparvata lugens
cacagtttgaacagcaagctgg

SEQ ID NO: 1325 - DNA, 24 bp, Nilaparvata lugens
gcagcagacgcaggcacaggtaga

SEQ ID NO: 1326 - DNA, 22 bp, Nilaparvata lugens
cacagtttgaacagcaagctgg

SEQ ID NO: 1327 - DNA, 23 bp, Nilaparvata lugens
caagcgaagatgttggacatgct

SEQ ID NO: 1328 - DNA, 29 bp, Nilaparvata lugens
atggtggtgggctggtaccactcgcaccc

SEQ ID NO: 1329 - DNA, 26 bp, Nilaparvata lugens
gtggtgggctggtaccactcgcaccc

SEQ ID NO: 1330 - DNA, 23 bp, Nilaparvata lugens
gtgggctggtaccactcgcaccc

SEQ ID NO: 1331 - DNA, 29 bp, Nilaparvata lugens
aagatgttggacatgctaaagcagacagg

SEQ ID NO: 1332 - DNA, 22 bp, Nilaparvata lugens
tgtcgggtgtcgacatcaacac

SEQ ID NO: 1333 - DNA, 21 bp, Nilaparvata lugens
gttcccatggaagttatgggc

SEQ ID NO: 1334 - DNA, 23 bp, Nilaparvata lugens
gtgggctggtaccactcgcaccc

SEQ ID NO: 1335 - DNA, 23 bp, Nilaparvata lugens
gagatcgatgccaaggccgagga

SEQ ID NO: 1336 - DNA, 21 bp, Nilaparvata lugens
gaattcaacattgaaaaggga

SEQ ID NO: 1337 - DNA, 23 bp, Nilaparvata lugens
gaagaattcaacattgaaaaggg

SEQ ID NO: 1338 - DNA, 23 bp, Nilaparvata lugens
gaagccaatgagaaagccgaaga

SEQ ID NO: 1339 - DNA, 23 bp, Nilaparvata lugens
tcgtcaaacatgctgaaccaagc

SEQ ID NO: 1340 - DNA, 24 bp, Nilaparvata lugens
tttcattgagcaagaagccaatga

SEQ ID NO: 1341 - DNA, 23 bp, Nilaparvata lugens
caagaagccaatgagaaagccga

SEQ ID NO: 1342 - DNA, 24 bp, Nilaparvata lugens
tttcattgagcaagaagccaatga

SEQ ID NO: 1343 - DNA, 21 bp, Nilaparvata lugens
agaagccaatgagaaagccga

SEQ ID NO: 1344 - DNA, 23 bp, Nilaparvata lugens
tcgtcaaacatgctgaaccaagc

SEQ ID NO: 1345 - DNA, 32 bp, Nilaparvata lugens
gccaatgagaaagccgaagagatcgatgccaa

SEQ ID NO: 1346 - DNA, 23 bp, Nilaparvata lugens
aaagccgaagagatcgatgccaa

SEQ ID NO: 1347 - DNA, 23 bp, Nilaparvata lugens
gagatcgatgccaaggccgagga

SEQ ID NO: 1348 - DNA, 23 bp, Nilaparvata lugens
gaagaattcaacattgaaaaggg

SEQ ID NO: 1349 - DNA, 29 bp, Nilaparvata lugens
gaagaattcaacattgaaaagggaaggct

SEQ ID NO: 1350 - DNA, 22 bp, Nilaparvata lugens
aagaattcaacattgaaaaggg

SEQ ID NO: 1351 - DNA, 23 bp, Nilaparvata lugens
gaggtgctgcgcatccacaccaa

SEQ ID NO: 1352 - DNA, 23 bp, Nilaparvata lugens
atccatgtgctgcccattgatga

SEQ ID NO: 1353 - DNA, 21 bp, Nilaparvata lugens
catgtgctgcccattgatgat

SEQ ID NO: 1354 - DNA, 31 bp, Nilaparvata lugens
ctgcgcatccacaccaagaacatgaagttgg

SEQ ID NO: 1355 - DNA, 23 bp, Nilaparvata lugens
ttcttcttcctcatcaacggacc

SEQ ID NO: 1356 - DNA, 21 bp, Nilaparvata lugens
gagatggtggagttgccgctg

SEQ ID NO: 1357 - DNA, 21 bp, Nilaparvata lugens
cagatcaaagagatggtggag

SEQ ID NO: 1358 - DNA, 21 bp, Nilaparvata lugens
atcaacggacccgagattatg

SEQ ID NO: 1359 - DNA, 23 bp, Nilaparvata lugens
atgaagatgatggccggtgcgtt

SEQ ID NO: 1360 - DNA, 24 bp, Nilaparvata lugens
ccggccatcatcttcatcgatgag

SEQ ID NO: 1361 - DNA, 26 bp, Nilaparvata lugens
atcatcttcatcgatgagctggacgc

SEQ ID NO: 1362 - DNA, 23 bp, Nilaparvata lugens
cagctgctgacgctgatggacgg

SEQ ID NO: 1363 - DNA, 29 bp, Nilaparvata lugens
atcgacattggcattcccgatgccaccgg

SEQ ID NO: 1364 - DNA, 30 bp, Nilaparvata lugens
tctatggagaacgtgtgcctgttcttgaac

SEQ ID NO: 1365 - DNA, 23 bp, Nilaparvata lugens
taccagtgcgagaagcacgtgct

SEQ ID NO: 1366 - DNA, 32 bp, Nilaparvata lugens
atggagaacgtgtgcctgttcttgaacctggc

SEQ ID NO: 1367 - DNA, 23 bp, Nilaparvata lugens
cgtggccagaaaatccccatctt

SEQ ID NO: 1368 - DNA, 26 bp, Nilaparvata lugens
tggcctaccagtgcgagaagcacgtg

SEQ ID NO: 1369 - DNA, 25 bp, Nilaparvata lugens
tggccaccatctacgagcgcgccgg

SEQ ID NO: 1370 - DNA, 26 bp, Nilaparvata lugens
atggagaacgtgtgcctgttcttgaa

SEQ ID NO: 1371 - DNA, 23 bp, Nilaparvata lugens
cccgaggaaatgatccagactgg

SEQ ID NO: 1372 - DNA, 28 bp, Nilaparvata lugens
tggcctaccagtgcgagaagcacgtgct

SEQ ID NO: 1373 - DNA, 48 bp, Nilaparvata lugens
gaggaggtgcccggccgtcgtggtttccccggttacatgtacaccgat

SEQ ID NO: 1374 - DNA, 23 bp, Nilaparvata lugens
gagggtcgcaacggctccatcac

SEQ ID NO: 1375 - DNA, 45 bp, Nilaparvata lugens
gaggtgcccggccgtcgtggtttccccggttacatgtacaccgat

SEQ ID NO: 1376 - DNA, 27 bp, Nilaparvata lugens
atggagaacgtgtgcctgttcttgaac

SEQ ID NO: 1377 - DNA, 37 bp, Nilaparvata lugens
tggcctaccagtgcgagaagcacgtgctcgtcatcct

SEQ ID NO: 1378 - DNA, 33 bp, Nilaparvata lugens
cgtcgtggtttccccggttacatgtacaccgat

SEQ ID NO: 1379 - DNA, 35 bp, Nilaparvata lugens
tggtcgcgtatctatcccgaggaaatgatccagac

SEQ ID NO: 1380 - DNA, 38 bp, Nilaparvata lugens
tggtcgcgtatctatcccgaggaaatgatccagactgg

SEQ ID NO: 1381 - DNA, 30 bp, Nilaparvata lugens; identical to SEQ ID NO: 1364

SEQ ID NO: 1382 - DNA, 27 bp, Nilaparvata lugens
atggagaacgtgtgcctgttcttgaac

SEQ ID NO: 1383 - DNA, 21 bp, Nilaparvata lugens
aacgtgtgcctgttcttgaac

SEQ ID NO: 1384 - DNA, 28 bp, Nilaparvata lugens
tggcctaccagtgcgagaagcacgtgct

SEQ ID NO: 1385 - DNA, 37 bp, Nilaparvata lugens; identical to SEQ ID NO: 1377

SEQ ID NO: 1386 - DNA, 26 bp, Nilaparvata lugens
gcctaccagtgcgagaagcacgtgct

SEQ ID NO: 1387 - DNA, 44 bp, Nilaparvata lugens
gaggaggtgcccggccgtcgtggtttccccggttacatgtacac

SEQ ID NO: 1388 - DNA, 48 bp, Nilaparvata lugens; identical to SEQ ID NO: 1373

SEQ ID NO: 1389 - DNA, 45 bp, Nilaparvata lugens; identical to SEQ ID NO: 1375

SEQ ID NO: 1390 - DNA, 23 bp, Nilaparvata lugens
cgtcgtggtttccccggttacat

SEQ ID NO: 1391 - DNA, 33 bp, Nilaparvata lugens; identical to SEQ ID NO: 1378

SEQ ID NO: 1392 - DNA, 30 bp, Nilaparvata lugens
cgtggtttccccggttacatgtacaccgat

SEQ ID NO: 1393 - DNA, 28 bp, Nilaparvata lugens
atcggtgtacatgtaaccggggaaacca

SEQ ID NO: 1394 - DNA, 23 bp, Nilaparvata lugens
cgtccggcgcgctcgtagatggt

SEQ ID NO: 1395 - DNA, 23 bp, Nilaparvata lugens
gagggtcgcaacggctccatcac

SEQ ID NO: 1396 - DNA, 21 bp, Nilaparvata lugens
cggacgtggcctggttcatca

SEQ ID NO: 1397 - DNA, 39 bp, Nilaparvata lugens
gtggtgtacgactgcaccgaccaggagtcgttcaacaac

SEQ ID NO: 1398 - DNA, 26 bp, Nilaparvata lugens
gaaagttacatcagtaccattggtgt

SEQ ID NO: 1399 - DNA, 25 bp, Nilaparvata lugens
caccgaccaggagtcgttcaacaac

SEQ ID NO: 1400 - DNA, 26 bp, Nilaparvata lugens
agtaccattggtgtagattttaaaat

SEQ ID NO: 1401 - DNA, 23 bp, Nilaparvata lugens
attggtgtagattttaaaattag

SEQ ID NO: 1402 - DNA, 23 bp, Nilaparvata lugens
ggtgtagattttaaaattagaac

SEQ ID NO: 1403 - DNA, 26 bp, Nilaparvata lugens
ggtgtagattttaaaattagaacaat

SEQ ID NO: 1404 - DNA, 22 bp, Nilaparvata lugens
gttctaattttaaaatctacac

SEQ ID NO: 1405 - DNA, 21 bp, Nilaparvata lugens
tgggacacggccggccaggag

SEQ ID NO: 1406 - DNA, 23 bp, Nilaparvata lugens
tgggacacggccggccaggagcg

SEQ ID NO: 1407 - DNA, 25 bp, Nilaparvata lugens
tgggacacggccggccaggagcggt

SEQ ID NO: 1408 - DNA, 23 bp, Nilaparvata lugens
gaccagctgggcattccgttcct

SEQ ID NO: 1409 - DNA, 21 bp, Nilaparvata lugens
attggtgtagattttaaaatt

SEQ ID NO: 1410 - DNA, 26 bp, Nilaparvata lugens
tgggacacggccggccaggagcggtt

SEQ ID NO: 1411 - DNA, 23 bp, Nilaparvata lugens
caggagcggttccgcacgatcac

SEQ ID NO: 1412 - DNA, 26 bp, Nilaparvata lugens
attggtgtagattttaaaattagaac

SEQ ID NO: 1413 - DNA, 23 bp, Nilaparvata lugens
attggtgtagattttaaaattag

SEQ ID NO: 1414 - DNA, 21 bp, Nilaparvata lugens
tgggacacggccggccaggag

SEQ ID NO: 1415 - DNA, 25 bp, Nilaparvata lugens
tgggacacggccggccaggagcggt

SEQ ID NO: 1416 - DNA, 32 bp, Nilaparvata lugens
gatgacacatacacagaaagttacatcagtac

SEQ ID NO: 1417 - DNA, 23 bp, Nilaparvata lugens
acggccggccaggagcggttccg

SEQ ID NO: 1418 - DNA, 26 bp, Nilaparvata lugens
agtaccattggtgtagattttaaaat

SEQ ID NO: 1419 - DNA, 22 bp, Nilaparvata lugens
taaagcttcagatttgggacac

SEQ ID NO: 1420 - DNA, 23 bp, Nilaparvata lugens
atttgggacacggccggccagga

SEQ ID NO: 1421 - DNA, 39 bp, Nilaparvata lugens; identical to SEQ ID NO: 1397

SEQ ID NO: 1422 - DNA, 26 bp, Nilaparvata lugens
ggtgtagattttaaaattagaacaat

SEQ ID NO: 1423 - DNA, 23 bp, Nilaparvata lugens
tgggacacggccggccaggagcg

SEQ ID NO: 1424 - DNA, 25 bp, Nilaparvata lugens
tcttcctcaccggtcaggaggagat

SEQ ID NO: 1425 - DNA, 26 bp, Nilaparvata lugens
aaattctccgagtttttcgacgatgc

SEQ ID NO: 1426 - DNA, 23 bp, Nilaparvata lugens
ttcctcaccggtcaggaggagat

SEQ ID NO: 1427 - DNA, 25 bp, Nilaparvata lugens
tagtattggccacaaatattgcaga

SEQ ID NO: 1428 - DNA, 23 bp, Nilaparvata lugens
tatttgaacatatgggtgccgca

SEQ ID NO: 1429 - DNA, 23 bp, Nilaparvata lugens
gagggagaggaaatgtggaatcc

SEQ ID NO: 1430 - DNA, 22 bp, Nilaparvata lugens
ccgaagattgtctgtatttgaa

SEQ ID NO: 1431 - DNA, 21 bp, Nilaparvata lugens
gattccgtttgcgaaacctcc

SEQ ID NO: 1432 - DNA, 23 bp, Nilaparvata lugens
ggtgcgttcggcttcctctacct

SEQ ID NO: 1433 - DNA, 21 bp, Nilaparvata lugens
caattcaatgctagggaaagg

SEQ ID NO: 1434 - DNA, 23 bp, Nilaparvata lugens
gagggagaggaaatgtggaatcc

SEQ ID NO: 1435 - DNA, 22 bp, Nilaparvata lugens
ccgaagattgtctgtatttgaa

SEQ ID NO: 1436 - DNA, 23 bp, Nilaparvata lugens
gacgtcatcgtcgcctccatgca

SEQ ID NO: 1437 - DNA, 21 bp, Nilaparvata lugens
ggagaccctggagctggtgcg

SEQ ID NO: 1438 - DNA, 24 bp, Nilaparvata lugens
agtacaagctgtgcaaagtgaaga

SEQ ID NO: 1439 - DNA, 24 bp, Nilaparvata lugens
atggatgttggacaaattgggtgg

SEQ ID NO: 1440 - DNA, 23 bp, Nilaparvata lugens
tggatgttggacaaattgggtgg

SEQ ID NO: 1441 - DNA, 24 bp, Nilaparvata lugens
agtacaagctgtgcaaagtgaaga

SEQ ID NO: 1442 - DNA, 22 bp, Nilaparvata lugens
agtccatccatcacgcccgtgt

SEQ ID NO: 1443 - DNA, 24 bp, Nilaparvata lugens
ctccgtaacaagcgtgaggtgtgg

SEQ ID NO: 1444 - DNA, 26 bp, Nilaparvata lugens
gactcgcagaagcacattgacttctc

SEQ ID NO: 1445 - DNA, 21 bp, Nilaparvata lugens
gcagaagcacattgacttctc

SEQ ID NO: 1446 - DNA, 22 bp, Nilaparvata lugens
gccaagtccatccatcacgccc

SEQ ID NO: 1447 - DNA, 26 bp, Nilaparvata lugens
gccaagtccatccatcacgcccgtgt

SEQ ID NO: 1448 - DNA, 23 bp, Nilaparvata lugens
tcgcagaagcacattgacttctc

SEQ ID NO: 1449 - DNA, 29 bp, Nilaparvata lugens
tcgcagaagcacattgacttctcgctgaa

SEQ ID NO: 1450 - DNA, 26 bp, Nilaparvata lugens
gccaagtccatccatcacgcccgtgt

SEQ ID NO: 1451 - DNA, 26 bp, Nilaparvata lugens
gactcgcagaagcacattgacttctc

SEQ ID NO: 1452 - DNA, 24 bp, Nilaparvata lugens
ctccgtaacaagcgtgaggtgtgg

SEQ ID NO: 1453 - DNA, 23 bp, Nilaparvata lugens
aagaacaaggatattcgtaaatt

SEQ ID NO: 1454 - DNA, 29 bp, Nilaparvata lugens
aagaacaaggatattcgtaaattcttgga

SEQ ID NO: 1455 - DNA, 26 bp, Nilaparvata lugens
ccgtgtacgcccatttccccatcaac

SEQ ID NO: 1456 - DNA, 21 bp, Nilaparvata lugens
tacgcccatttccccatcaac

SEQ ID NO: 1457 - DNA, 23 bp, Nilaparvata lugens
caacatgaatgcattcctcaagc

SEQ ID NO: 1458 - DNA, 23 bp, Nilaparvata lugens
gaagtacaacatgaatgcattcc

SEQ ID NO: 1459 - DNA, 21 bp, Nilaparvata lugens
gctgtatttgtgttggcgaca

SEQ ID NO: 1460 - DNA, 21 bp, Nilaparvata lugens
agaaaaggttgtgggttggta

SEQ ID NO: 1461 - DNA, 35 bp, Nilaparvata lugens
ggacttcgtgatggatattacattcagggacaatg

SEQ ID NO: 1462 - DNA, 21 bp, Nilaparvata lugens
caactacaacttcgagaagcc

SEQ ID NO: 1463 - DNA, 23 bp, Nilaparvata lugens
gaagaattcaacattgaaaaggg

SEQ ID NO: 1464 - DNA, 23 bp, Nilaparvata lugens
gagcaagaagccaatgagaaagc

SEQ ID NO: 1465 - DNA, 36 bp, Nilaparvata lugens
tttcattgagcaagaagccaatgagaaagccgaaga

SEQ ID NO: 1466 - DNA, 27 bp, Nilaparvata lugens
atgagcaaattggccggcgagtcggag

SEQ ID NO: 1467 - DNA, 26 bp, Nilaparvata lugens
cacaccaagaacatgaagttggctga

SEQ ID NO: 1468 - DNA, 21 bp, Nilaparvata lugens
caggaaatctgttcgaagtgt

SEQ ID NO: 1469 - DNA, 23 bp, Nilaparvata lugens
ctggcgcagatcaaagagatggt

SEQ ID NO: 1470 - DNA, 22 bp, Nilaparvata lugens
tggcgcagatcaaagagatggt

SEQ ID NO: 1471 - DNA, 23 bp, Nilaparvata lugens
tatcccgaggaaatgatccagac

SEQ ID NO: 1472 - DNA, 38 bp, Nilaparvata lugens
cgtatctatcccgaggaaatgatccagactggaatttc

SEQ ID NO: 1473 - DNA, 21 bp, Nilaparvata lugens
tggatgggagtcatgcatgga

SEQ ID NO: 1474 - DNA, 24 bp, Nilaparvata lugens
ccaagggcaagggtgtgaagctca

SEQ ID NO: 1475 - DNA, 23 bp, Nilaparvata lugens
tctctgcccaagggcaagggtgt

SEQ ID NO: 1476 - DNA, 21 bp, Nilaparvata lugens
tctgcccaagggcaagggtgt

SEQ ID NO: 1477 - DNA, 21 bp, Nilaparvata lugens
tctctgcccaagggcaagggt

SEQ ID NO: 1478 - DNA, 23 bp, Nilaparvata lugens
tctctgcccaagggcaagggtgt

SEQ ID NO: 1479 - DNA, 24 bp, Nilaparvata lugens
ctgcccaagggcaagggtgtgaag

SEQ ID NO: 1480 - DNA, 22 bp, Nilaparvata lugens
atgaagctcgattacgtcttgg

SEQ ID NO: 1481 - DNA, 21 bp, Nilaparvata lugens
cgtaaggccgctcgtgagctg

SEQ ID NO: 1482 - DNA, 26 bp, Nilaparvata lugens
cgtaaggccgctcgtgagctgttgac

SEQ ID NO: 1483 - DNA, 23 bp, Nilaparvata lugens
gactcgcagaagcacattgactt

SEQ ID NO: 1484 - DNA, 21 bp, Nilaparvata lugens
tgaagctcgattacgtcttgg

SEQ ID NO: 1485 - DNA, 28 bp, Nilaparvata lugens
tggccaagtccatccatcacgcccgtgt

SEQ ID NO: 1486 - DNA, 21 bp, Nilaparvata lugens
cgtaacttcctgggcgagaag

SEQ ID NO: 1487 - DNA, 22 bp, Nilaparvata lugens
atgaagctcgattacgtcttgg

SEQ ID NO: 1488 - DNA, 22 bp, Nilaparvata lugens
tcggtttggccaagtccatcca

SEQ ID NO: 1489 - DNA, 23 bp, Nilaparvata lugens
gactcgcagaagcacattgactt

SEQ ID NO: 1490 - DNA, 26 bp, Nilaparvata lugens
gactcgcagaagcacattgacttctc

SEQ ID NO: 1491 - DNA, 21 bp, Nilaparvata lugens
tacgcccatttccccatcaac

SEQ ID NO: 1492 - DNA, 25 bp, Nilaparvata lugens
cgtgtacgcccatttccccatcaac

SEQ ID NO: 1493 - DNA, 21 bp, Nilaparvata lugens
tacgcccatttccccatcaac

SEQ ID NO: 1494 - DNA, 23 bp, Nilaparvata lugens
tacgcccatttccccatcaactg

SEQ ID NO: 1495 - DNA, 25 bp, Nilaparvata lugens
cgtgtacgcccatttccccatcaac

SEQ ID NO: 1496 - DNA, 21 bp, Nilaparvata lugens
aaaaggtcaaggaggccaaga

SEQ ID NO: 1497 - DNA, 26 bp, Nilaparvata lugens
ttcaagaacaagcgtgtattgatgga

SEQ ID NO: 1498 - DNA, 28 bp, Nilaparvata lugens
ttcaagaacaagcgtgtattgatggagt

SEQ ID NO: 1499 - DNA, 21 bp, Nilaparvata lugens
cctggaggaggagacgaccat

SEQ ID NO: 1500 - DNA, 22 bp, Nilaparvata lugens
tcccatctcgtatgacaattgg

SEQ ID NO: 1501 - DNA, 21 bp, Nilaparvata lugens
atggtcgtctcctcctccagg

SEQ ID NO: 1502 - DNA, 22 bp, Nilaparvata lugens
tcccatctcgtatgacaattgg

SEQ ID NO: 1503 - DNA, 23 bp, Nilaparvata lugens
caagtcatgatgttcagtgcaac

SEQ ID NO: 1504 - DNA, 23 bp, Nilaparvata lugens
tgacgcttcacggcctgcagcag

SEQ ID NO: 1505 - DNA, 23 bp, Nilaparvata lugens
caagtcatgatgttcagtgcaac

SEQ ID NO: 1506 - DNA, 23 bp, Nilaparvata lugens
caattcttgcaagtgttcaacaa

SEQ ID NO: 1507 - DNA, 23 bp, Nilaparvata lugens
ttcaacaacagtcctgatgaaac

SEQ ID NO: 1508 - DNA, 21 bp, Nilaparvata lugens
ttcttgcaagtgttcaacaac

SEQ ID NO: 1509 - DNA, 21 bp, Nilaparvata lugens
aagaacgttcccaactggcac

SEQ ID NO: 1510 - DNA, 22 bp, Nilaparvata lugens
acaagaacgttcccaactggca

SEQ ID NO: 1511 - DNA, 22 bp, Nilaparvata lugens
acctacaagaacgttcccaact

SEQ ID NO: 1512 - DNA, 27 bp, Nilaparvata lugens
acctacaagaacgttcccaactggcac

SEQ ID NO: 1513 - DNA, 21 bp, Nilaparvata lugens
caactacaacttcgagaagcc

SEQ ID NO: 1514 - DNA, 22 bp, Nilaparvata lugens
caagaacgttcccaactggcac

SEQ ID NO: 1515 - DNA, 22 bp, Nilaparvata lugens
cacctacaagaacgttcccaac

SEQ ID NO: 1516 - DNA, 22 bp, Nilaparvata lugens
cctacaagaacgttcccaactg

SEQ ID NO: 1517 - DNA, 22 bp, Nilaparvata lugens
ctacaagaacgttcccaactgg

SEQ ID NO: 1518 - DNA, 22 bp, Nilaparvata lugens
gcaactacaacttcgagaagcc

SEQ ID NO: 1519 - DNA, 22 bp, Nilaparvata lugens
tacaagaacgttcccaactggc

SEQ ID NO: 1520 - DNA, 21 bp, Nilaparvata lugens
tcacctacaagaacgttccca

SEQ ID NO: 1521 - DNA, 22 bp, Nilaparvata lugens
tcacctacaagaacgttcccaa

SEQ ID NO: 1522 - DNA, 24 bp, Nilaparvata lugens
tcacctacaagaacgttcccaact

SEQ ID NO: 1523 - DNA, 29 bp, Nilaparvata lugens
tcacctacaagaacgttcccaactggcac

SEQ ID NO: 1524 - DNA, 22 bp, Nilaparvata lugens
tgggacacagctggccaggaaa

SEQ ID NO: 1525 - DNA, 21 bp, Nilaparvata lugens
ttcgagaagccgttcctgtgg

SEQ ID NO: 1526 - DNA, 26 bp, Nilaparvata lugens
ttcgagaagccgttcctgtggttggc

SEQ ID NO: 1527 - DNA, 22 bp, Nilaparvata lugens
tgggacacagctggccaggaaa

SEQ ID NO: 1528 - DNA, 22 bp, Nilaparvata lugens
tattacattcagggacaatgcg

SEQ ID NO: 1529 - DNA, 29 bp, Nilaparvata lugens
tcacctacaagaacgttcccaactggcac

SEQ ID NO: 1530 - DNA, 27 bp, Nilaparvata lugens
acctacaagaacgttcccaactggcac

SEQ ID NO: 1531 - DNA, 23 bp, Nilaparvata lugens
tacaagaacgttcccaactggca

SEQ ID NO: 1532 - DNA, 24 bp, Nilaparvata lugens
tacaagaacgttcccaactggcac

SEQ ID NO: 1533 - DNA, 22 bp, Nilaparvata lugens
aggaagaagaaccttcagtact

SEQ ID NO: 1534 - DNA, 23 bp, Nilaparvata lugens
aagaagaaccttcagtactacga

SEQ ID NO: 1535 - DNA, 27 bp, Nilaparvata lugens
aagaagaaccttcagtactacgacatc

SEQ ID NO: 1536 - DNA, 24 bp, Nilaparvata lugens
aagaaccttcagtactacgacatc

SEQ ID NO: 1537 - DNA, 22 bp, Nilaparvata lugens
ggcttctcgaagttgtagttgc

SEQ ID NO: 1538 - DNA, 21 bp, Nilaparvata lugens
caactacaacttcgagaagcc

SEQ ID NO: 1539 - DNA, 21 bp, Nilaparvata lugens
ggcttctcgaagttgtagttg

SEQ ID NO: 1540 - DNA, 26 bp, Nilaparvata lugens
cccgagatggtggtgggctggtacca

SEQ ID NO: 1541 - DNA, 22 bp, Nilaparvata lugens
ggtaccactcgcacccgggctt

SEQ ID NO: 1542 - DNA, 47 bp, Nilaparvata lugens
gtgggctggtaccactcgcacccgggcttcggctgctggctgtcggg

SEQ ID NO: 1543 - DNA, 23 bp, Nilaparvata lugens
tggtaccactcgcacccgggctt

SEQ ID NO: 1544 - DNA, 26 bp, Nilaparvata lugens
cccgagatggtggtgggctggtacca

SEQ ID NO: 1545 - DNA, 21 bp, Nilaparvata lugens
atccacaccaagaacatgaag

SEQ ID NO: 1546 - DNA, 22 bp, Nilaparvata lugens
cacaccaagaacatgaagttgg

SEQ ID NO: 1547 - DNA, 23 bp, Nilaparvata lugens
gccttcttcttcctcatcaacgg

SEQ ID NO: 1548 - DNA, 22 bp, Nilaparvata lugens
ttggaggctgcagaaagcagct

SEQ ID NO: 1549 - DNA, 23 bp, Nilaparvata lugens
gccttcttcttcctcatcaacgg

SEQ ID NO: 1550 - DNA, 21 bp, Nilaparvata lugens
atccacaccaagaacatgaag

SEQ ID NO: 1551 - DNA, 23 bp, Nilaparvata lugens
cacaccaagaacatgaagttggc

SEQ ID NO: 1552 - DNA, 21 bp, Nilaparvata lugens
catgaactcgattgctcgtgg

SEQ ID NO: 1553 - DNA, 25 bp, Nilaparvata lugens
ccaccatctacgagcgcgccggacg

SEQ ID NO: 1554 - DNA, 21 bp, Nilaparvata lugens
catgaactcgattgctcgtgg

SEQ ID NO: 1555 - DNA, 21 bp, Nilaparvata lugens
catgtcggtgaggatgacgag

SEQ ID NO: 1556 - DNA, 25 bp, Nilaparvata lugens
ccaccatctacgagcgcgccggacg

SEQ ID NO: 1557 - DNA, 29 bp, Nilaparvata lugens
cagatttgggacacggccggccaggagcg

SEQ ID NO: 1558 - DNA, 21 bp, Nilaparvata lugens
gaccaggagtcgttcaacaac

SEQ ID NO: 1559 - DNA, 21 bp, Nilaparvata lugens
tgggacacggccggccaggag

SEQ ID NO: 1560 - DNA, 23 bp, Nilaparvata lugens
tgggacacggccggccaggagcg

SEQ ID NO: 1561 - DNA, 26 bp, Nilaparvata lugens
tgggacacggccggccaggagcggtt

SEQ ID NO: 1562 - DNA, 26 bp, Nilaparvata lugens
ttcctggagacgtcggcgaagaacgc

SEQ ID NO: 1563 - DNA, 29 bp, Nilaparvata lugens
cagatttgggacacggccggccaggagcg

SEQ ID NO: 1564 - DNA, 21 bp, Nilaparvata lugens
tgggacacggccggccaggag

SEQ ID NO: 1565 - DNA, 23 bp, Nilaparvata lugens
tgggacacggccggccaggagcg

SEQ ID NO: 1566 - DNA, 26 bp, Nilaparvata lugens
tgggacacggccggccaggagcggtt

SEQ ID NO: 1567 - DNA, 29 bp, Nilaparvata lugens
tgggacacggccggccaggagcggttccg

SEQ ID NO: 1568 - DNA, 22 bp, Nilaparvata lugens
caggcaaagattttcctgccca

SEQ ID NO: 1569 - DNA, 23 bp, Nilaparvata lugens
ggcaagtgcttccgtctgtacac

SEQ ID NO: 1570 - DNA, 21 bp, Nilaparvata lugens
ggatgaccaaaaacgtattct

SEQ ID NO: 1571 - DNA, 21 bp, Nilaparvata lugens
agaatacgtttttggtcatcc

SEQ ID NO: 1572 - DNA, 697 bp, Nilaparvata lugens
gaaatcatggatgttggacaaattgggtggtgtgtatgcaccccgacccagcacaggtccacacaagctgcgagaatctctcccacttgtcatatttttgcgtaatcggctcaagtacgctttaactaactgtgaagtgaagaaaattgtgatgcagcgtctcatcaaggttgacggcaaagtgaggactgaccccaactatcctgcaggttttatggacgttgttcaaatcgaaaagacaaacgagttcttccgtttgatctatgatgttaagggacgtttcaccatccacaggatcacagctgaagaagctaagtacaagctgtgcaaagtgaagagggttcagacaggacccaagggcattccatttttgaccactcacgatggacgcaccatcaggtatccagaccccttagtaaaagtcaatgacaccatccaattggacattgccacatccaaaatcatggacttcatcagattcgactctggtaacctgtgtatgatcactggaggtcgtaacttgggtcgtgtgggcactgtcgtgaacagggagcgacacccggggtctttcgacatcgtgcacatcaaggacgtgttgggacacacttttgccactaggttgaacaacgttttcatcatcggcaagggtagtaaagcatacgtgtctctgcccaagggcaagggtgtgaagctcagt

SEQ ID NO: 1573 - DNA, 48 bp, artificial sequence
  Description of artificial sequence:  synthetic primer
gcgtaatacgactcactatagggaaatcatggatgttggacaaattgg

SEQ ID NO: 1574 - DNA, 22 bp, artificial sequence
  Description of artificial sequence:  synthetic primer
actgagcttcacacccttgccc

SEQ ID NO: 1575 - DNA, 26 bp, artificial sequence
  Description of artificial sequence:  synthetic primer
gaaatcatggatgttggacaaattgg

SEQ ID NO: 1576 - DNA, 44 bp, artificial sequence
  Description of artificial sequence:  synthetic primer
gcgtaatacgactcactataggactgagcttcacacccttgccc

SEQ ID NO: 1577 - DNA, 336 bp, Nilaparvata lugens; identical to SEQ ID NO: 1073

SEQ ID NO: 1578 - DNA, 46 bp, artificial sequence
  Description of artificial sequence:  synthetic primer
gcgtaatacgactcactatagggatgaaaagggccctacaactggc

SEQ ID NO: 1579 - DNA, 26 bp, artificial sequence
  Description of artificial sequence:  synthetic primer
ctgatccacatccatgtgttgatgag

SEQ ID NO: 1580 - DNA, 24 bp, artificial sequence
  Description of artificial sequence:  synthetic primer
gatgaaaagggccctacaactggc

SEQ ID NO: 1581 - DNA, 48 bp, artificial sequence
  Description of artificial sequence:  synthetic primer
gcgtaatacgactcactataggctgatccacatccatgtgttgatgag

SEQ ID NO: 1582 - DNA, 477 bp, Nilaparvata lugens; identical to SEQ ID NO: 1075

SEQ ID NO: 1583 - DNA, 46 bp, artificial sequence
  Description of artificial sequence:  synthetic primer
gcgtaatacgactcactataggtccgcgtcgtccttacgagaaggc

SEQ ID NO: 1584 - DNA, 22 bp, artificial sequence
  Description of artificial sequence:  synthetic primer
ttgacgcgaccaggtcggccac

SEQ ID NO: 1585 - DNA, 24 bp, artificial sequence
  Description of artificial sequence:  synthetic primer
tccgcgtcgtccttacgagaaggc

SEQ ID NO: 1586 - DNA, 44 bp, artificial sequence
  Description of artificial sequence:  synthetic primer
gcgtaatacgactcactataggttgacgcgaccaggtcggccac

SEQ ID NO: 1587 - DNA, 305 bp, Nilaparvata lugens
ggagttggctgctgtaagaactgtctgctctcacatcgaaaacatgctgaagggagtcacaaagggattcctgtacaagatgcgtgccgtgtacgcccatttccccatcaactgtgtgacgaccgagaacaactctgtgatcgaggtgcgtaacttcctgggcgagaagtacatccgacgggtgaggatggcgcccggcgtcactgttaccaactcgacaaagcagaaggacgagctcatcgtcgaaggaaacagcatagaggacgtgtcaagatcagctgccctcatccaacagtcaacaacag

SEQ ID NO: 1588 - DNA, 45 bp, artificial sequence
  Description of artificial sequence:  synthetic primer
gcgtaatacgactcactataggggagttggctgctgtaagaactg

SEQ ID NO: 1589 - DNA, 23 bp, artificial sequence
  Description of artificial sequence:  synthetic primer
ctgttgttgactgttggatgagg

SEQ ID NO: 1590 - DNA, 23 bp, artificial sequence
  Description of artificial sequence:  synthetic primer
ggagttggctgctgtaagaactg

SEQ ID NO: 1591 - DNA, 45 bp, artificial sequence
  Description of artificial sequence:  synthetic primer
gcgtaatacgactcactataggctgttgttgactgttggatgagg

SEQ ID NO: 1592 - DNA, 424 bp, Nilaparvata lugens
cgcaaacacaaattcacgtcaaagcatcaggaagctgatcaaagacggtcttatcatcaagaaaccggttgcagtacattcacgtgctcgcgttcgtaaaaacactgaagccaggaggaaaggcagacattgtggctttggtaagaggaaaggtacagccaacgcccgtatgccacaaaaggttctatgggtgaatcgtatgcgtgtcttgagaagactgttgaaaaaatacagacaagataagaaaatcgacaggcatctgtaccatcacctttacatgaaggctaagggtaacgtattcaagaacaagcgtgtattgatggagttcattcataagaagaaggccgagaaagcaagaatgaagatgttgaacgaccaggctgaagctcgcagacaaaaggtcaaggaggccaagaagcgaagg

SEQ ID NO: 1593 - DNA, 47 bp, artificial sequence
  Description of artificial sequence:  synthetic primer
gcgtaatacgactcactataggcgcaaacacaaattcacgtcaaagc

SEQ ID NO: 1594 - DNA, 24 bp, artificial sequence
  Description of artificial sequence:  synthetic primer
ccttcgcttcttggcctccttgac

SEQ ID NO: 1595 - DNA, 25 bp, artificial sequence
  Description of artificial sequence:  synthetic primer
cgcaaacacaaattcacgtcaaagc

SEQ ID NO: 1596 - DNA, 46 bp, artificial sequence
  Description of artificial sequence:  synthetic primer
gcgtaatacgactcactataggccttcgcttcttggcctccttgac

SEQ ID NO: 1597 - DNA, 965 bp, Nilaparvata lugens
gtgcttgtgtcaagtggtgtggtggagtacattgacaccctggaggaggagacgaccatgatagcgatgtcgccggatgacctgcgtcaggacaaggagtatgcctactgtaccacctacacgcactgcgagatccacccggccatgatactcggtgtgtgcgcctctattattcccttccccgatcacaaccaaagtcccaggaacacctatcagagcgctatggggaaacaggcgatgggcgtgtacatcaccaacttccacgtgcgaatggacacgctggctcacgtgctgttctacccgcacaagccactggtcaccactcgctccatggagtacctgcgcttcagggagcttcctgccggcatcaactctgtggtcgccatcgcctgctacactggatacaaccaggaggacagtgtcattctcaacgcctccgctgtcgagcgcggattcttcagatcggttttcttccgatcttacaaagatgcagaatcgaagcgtattggcgaccaagaggagcaattcgagaagcccaccagacagacgtgtcagggaatgaggaatgccatttatgacaaattggacgatgatggcatcattgctcccggtctgagagtgtctggtgacgatgtggttattggcaaaaccataacactgcccgataatgatgacgagctggaaggtacaacaaagaggttcacgaagagagatgccagtactttcctgcgtaacagtgagacgggaatcgtcgaccaagtcatgttaaccttgaactctgagggttacaagttctgcaaaattcgagtcaggtctgtgcgtatcccgcagattggcgataagttcgcttcccgacatggccaaaaaggaacgtgtggaatacagtatcgtcaagaggacatgccttttacaagcgagggaatcgcaccggatattattatcaatcctcacgctatcccatctcg

SEQ ID NO: 1598 - DNA, 44 bp, artificial sequence
  Description of artificial sequence:  synthetic primer
gcgtaatacgactcactatagggtgcttgtgtcaagtggtgtgg

SEQ ID NO: 1599 - DNA, 20 bp, artificial sequence
  Description of artificial sequence:  synthetic primer
cgagatgggatagcgtgagg

SEQ ID NO: 1600 - DNA, 22 bp, artificial sequence
  Description of artificial sequence:  synthetic primer
gtgcttgtgtcaagtggtgtgg

SEQ ID NO: 1601 - DNA, 42 bp, artificial sequence
  Description of artificial sequence:  synthetic primer
gcgtaatacgactcactataggcgagatgggatagcgtgagg

SEQ ID NO: 1602 - DNA, 790 bp, Nilaparvata lugens
tgagagcaatccttgactgtggttttgaacatccatctgaagtacaacatgaatgcattcctcaagctgtacttggaatggacatattgtgtcaagcgaaatccggtatgggaaaaactgctgtatttgtgttggcgacattacagcaaattgaaccaactgacaaccaagtcagtgtattggtcatgtgtcataccagagagcttgcattccaaatcagcaaagagtatgaacgattttcgaaatgtatgccaaatatcaaggttggagttttcttcggcggactgccgattcagagggatgaggagacgttgaaattgaactgtcctcacatcgtggttggaacacccggacgaattttggcgttggtacgcaacaagaagctggacctcaagcatctcaagcactttgtccttgacgaatgtgacaaaatgttggaactgttagatatgcgaagagatgtgcaggaaatattccgaaacacgccgcacagcaaacaagtcatgatgttcagtgcaactctcagcaaagaaattcgtccagtctgcaagaaattcatgcaagatccgatggaagtgtacgttgatgacgaggccaagctgacgcttcacggcctgcagcagcactatgtcaaactcaaagaaaacgaaaagaacaaaaagttatttgaattacttgacatacttgaattcaaccaggttgttatatttgtgaagtcagtgcagcgctgcatggccctatcgcaactcctaacagagcagaacttccctgcagtggctattcaccgtgg

SEQ ID NO: 1603 - DNA, 44 bp, artificial sequence
  Description of artificial sequence:  synthetic primer
gcgtaatacgactcactataggtgagagcaatccttgactgtgg

SEQ ID NO: 1604 - DNA, 20 bp, artificial sequence
  Description of artificial sequence:  synthetic primer
ccacggtgaatagccactgc

SEQ ID NO: 1605 - DNA, 22 bp, artificial sequence
  Description of artificial sequence:  synthetic primer
tgagagcaatccttgactgtgg

SEQ ID NO: 1606 - DNA, 42 bp, artificial sequence
  Description of artificial sequence:  synthetic primer
gcgtaatacgactcactataggccacggtgaatagccactgc

SEQ ID NO: 1607 - DNA, 629 bp, Nilaparvata lugens
gatgctggagacctggaggtgtattagatgtttcaaacagttttgcagttccatttgatgaggacgacaaagaaaagaatgtttggttcttagaccatgattacttggaaaacatgttcgggatgttcaagaaagttaatgctagagaaaaggttgtgggttggtaccatactggacccaaactccaccaaaacgatgttgcaatcaatgagttgattcgtcgttactgtccaaactgtgtcttagtcataatcgatgccaagcctaaagatttgggtctacctacagaggcatacagagtcgttgaagaaatccatgatgatggatcgccaacatcaaaaacatttgaacatgtgatgagtgagattggggcagaagaggctgaggagattggcgttgaacatctgttgagagacatcaaagatacaacagtcgggtcactgtcacagcgcgtcacaaatcagctgatgggcttgaagggcttgcatctgcaattacaggatatgcgagactatttgaatcaggttgtcgaaggaaagttgccaatgaaccatcaaatcgtttaccaactgcaagacatcttcaaccttctacccgatatcggccacggcaattttgtagactcgctc

SEQ ID NO: 1608 - DNA, 43 bp, artificial sequence
  Description of artificial sequence:  synthetic primer
gcgtaatacgactcactatagggatgctggagacctggaggtg

SEQ ID NO: 1609 - DNA, 22 bp, artificial sequence
  Description of artificial sequence:  synthetic primer
gagcgagtctacaaaattgccg

SEQ ID NO: 1610 - DNA, 21 bp, artificial sequence
  Description of artificial sequence:  synthetic primer
gatgctggagacctggaggtg

SEQ ID NO: 1611 - DNA, 44 bp, artificial sequence
  Description of artificial sequence:  synthetic primer
gcgtaatacgactcactatagggagcgagtctacaaaattgccg

SEQ ID NO: 1612 - DNA, 355 bp, Nilaparvata lugens
gcgactatgatcgaccgccgggacgcggtcaggtgtgcgacgtcgacgtcaagaactggtttccctgcacctctgagaacaatttcaactaccatcaatcgagcccttgtgtttttctcaaactgaacaagataattggttggcaaccggagtactacaatgagactgaaggctttccagataatatgccaggtgacctcaagcgacacattgcccaacagaagagtatcaacaagctgtttatgcaaacaatctggataacttgcgaaggagagggtcctctagacaaggagaatgcaggggagatccagtacatccctagacagggatttccgggctacttctacccttacac

SEQ ID NO: 1613 - DNA, 41 bp, artificial sequence
  Description of artificial sequence:  synthetic primer
gcgtaatacgactcactatagggcgactatgatcgaccgcc

SEQ ID NO: 1614 - DNA, 23 bp, artificial sequence
  Description of artificial sequence:  synthetic primer
gtgtaagggtagaagtagcccgg

SEQ ID NO: 1615 - DNA, 19 bp, artificial sequence
  Description of artificial sequence:  synthetic primer
gcgactatgatcgaccgcc

SEQ ID NO: 1616 - DNA, 45 bp, artificial sequence
  Description of artificial sequence:  synthetic primer
gcgtaatacgactcactatagggtgtaagggtagaagtagcccgg

SEQ ID NO: 1617 - DNA, 711 bp, Nilaparvata lugens
gcttgttgttcccgttggatgtctgtatcaacctttgaaggagagacctgatctaccgcctgtacagtacgatccagttctttgtactaggaatacttgtcgtgcaattctgaatccattgtgccaagtcgactatcgagccaagctatgggtctgcaacttttgtttccagaggaatcctttcccccctcaatatgcagctatttcggagcagcatcaaccagcagaactgataccttcattttccaccatcgaatacatcattaccagagcgcaaacgatgccgccgatgttcgtgctggtggtggacacatgtctggacgacgaggagctgggagctttgaaggactcactgcagatgtcgctgtcgctgctgccgcccaatgcactcatcggtctcatcacgttcggcaaaatggtgcaggtgcacgagcttggctgcgacggctgctcgaagagctacgtgttccgtggcgtgaaggacctgactgccaagcagatccaggacatgttgggcattggcaagatggccgccgctccacagcccatgcaacagcgcattcccggcgccgctccctccgcacctgtcaacagatttcttcagcctgtcggaaagtgcgatatgagtttaactgatctgcttggggaattgcaaagagatccatggaatgtggctcagggcaagagacctctccgatctactggagttgc

SEQ ID NO: 1618 - DNA, 45 bp, artificial sequence
  Description of artificial sequence:  synthetic primer
gcgtaatacgactcactatagggcttgttgttcccgttggatgtc

SEQ ID NO: 1619 - DNA, 25 bp, artificial sequence
  Description of artificial sequence:  synthetic primer
gcaactccagtagatcggagaggtc

SEQ ID NO: 1620 - DNA, 23 bp, artificial sequence
  Description of artificial sequence:  synthetic primer
gcttgttgttcccgttggatgtc

SEQ ID NO: 1621 - DNA, 47 bp, artificial sequence
  Description of artificial sequence:  synthetic primer
gcgtaatacgactcactatagggcaactccagtagatcggagaggtc

SEQ ID NO: 1622 - DNA, 453 bp, Nilaparvata lugens
gttgccacccttggagttgaagttcacccccttgtatttcacacaaacagaggtgtgattaggttcaatgtgtgggacacagctggccaggaaaagttcggtggacttcgtgatggatattacattcagggacaatgcgccatcattatgtttgacgtaacgtcaagagtcacctacaagaacgttcccaactggcacagagatttagtgagggtttgcgaaaacattcccattgtactatgcggcaacaaagtagacatcaaggacaggaaagtcaaggccaagagcatagtcttccataggaagaagaaccttcagtactacgacatcagtgcgaaaagcaactacaacttcgagaagccgttcctgtggttggcaaagaagctgatcggtgaccccaacctggagttcgtcgccatgcccgccctcctcccacccgaggtcacaatggac

SEQ ID NO: 1623 - DNA, 26 bp, artificial sequence
  Description of artificial sequence:  synthetic primer
cccactttcaagtgygtrytrgtcgg

SEQ ID NO: 1624 - DNA, 21 bp, artificial sequence
  Description of artificial sequence:  synthetic primer
gtccattgtgacctcgggagg

SEQ ID NO: 1625 - DNA, 22 bp, artificial sequence
  Description of artificial sequence:  synthetic primer
gttgccacccttggagttgaag

SEQ ID NO: 1626 - DNA, 43 bp, artificial sequence
  Description of artificial sequence:  synthetic primer
gcgtaatacgactcactatagggtccattgtgacctcgggagg

SEQ ID NO: 1627 - DNA, 169 bp, Nilaparvata lugens; identical to SEQ ID NO: 1093

SEQ ID NO: 1628 - DNA, 45 bp, artificial sequence
  Description of artificial sequence:  synthetic primer
gcgtaatacgactcactatagggcagcagacgcaggcacaggtag

SEQ ID NO: 1629 - DNA, 27 bp, artificial sequence
  Description of artificial sequence:  synthetic primer
gaatttcctcttgagtttgccagcttg

SEQ ID NO: 1630 - DNA, 23 bp, artificial sequence
  Description of artificial sequence:  synthetic primer
gcagcagacgcaggcacaggtag

SEQ ID NO: 1631 - DNA, 49 bp, artificial sequence
  Description of artificial sequence:  synthetic primer
gcgtaatacgactcactatagggaatttcctcttgagtttgccagcttg

SEQ ID NO: 1632 - DNA, 346 bp, Nilaparvata lugens
cgcagagcaagtctacatctcttcactggccttattgaaaatgcttaagcacggtcgcgccggtgttcccatggaagttatgggcctaatgctgggcgaatttgtagacgactacactgtgcgtgtcattgatgtattcgctatgccacagagtggaacgggagtgagtgtggaggctgtagacccggtgttccaagcgaagatgttggacatgctaaagcagacaggacggcccgagatggtggtgggctggtaccactcgcacccgggcttcggctgctggctgtcgggtgtcgacatcaacacgcaggagagcttcgagcaactatccaagagagccgttgcc

SEQ ID NO: 1633 - DNA, 46 bp, artificial sequence
  Description of artificial sequence:  synthetic primer
gcgtaatacgactcactataggcgcagagcaagtctacatctcttc

SEQ ID NO: 1634 - DNA, 21 bp, artificial sequence
  Description of artificial sequence:  synthetic primer
ggcaacggctctcttggatag

SEQ ID NO: 1635 - DNA, 24 bp, artificial sequence
  Description of artificial sequence:  synthetic primer
cgcagagcaagtctacatctcttc

SEQ ID NO: 1636 - DNA, 43 bp, artificial sequence
  Description of artificial sequence:  synthetic primer
gcgtaatacgactcactataggggcaacggctctcttggatag

SEQ ID NO: 1637 - DNA, 592 bp, Nilaparvata lugens
cattgagcaagaagccaatgagaaagccgaagagatcgatgccaaggccgaggaagaattcaacattgaaaagggaaggctcgtacagcaccagcgccttaaaatcatggagtactatgacaggaaagagaagcaggttgagctccagaaaaaaatccaatcgtcaaacatgctgaaccaagcgcgtctgaaggcactgaaggtgcgcgaagatcacgtgagaagtgtgctcgaagaatccagaaaacgtcttggagaagtaaccagaaacccagccaagtacaaggaagtcctccagtatctaattgtccaaggactcctgcagctgctagaatcaaacgtagtactgcgcgtgcgcgaggctgacgtgagtctgatcgagggcattgttggctcatgcgcagagcagtacgcgaagatgaccggcaaagaggtggtggtgaagctggacgctgacaacttcctggccgccgagacgtgtggaggcgtcgagttgttcgcccgcaacggccgcatcaagatccccaacaccctcgagtccaggctcgacctcatctcccagcaacttgtgcccgagattagagtcgcgctc

SEQ ID NO: 1638 - DNA, 44 bp, artificial sequence
  Description of artificial sequence:  synthetic primer
gcgtaatacgactcactataggcattgagcaagaagccaatgag

SEQ ID NO: 1639 - DNA, 20 bp, artificial sequence
  Description of artificial sequence:  synthetic primer
gagcgcgactctaatctcgg

SEQ ID NO: 1640 - DNA, 22 bp, artificial sequence
  Description of artificial sequence:  synthetic primer
cattgagcaagaagccaatgag

SEQ ID NO: 1641 - DNA, 42 bp, artificial sequence
  Description of artificial sequence:  synthetic primer
gcgtaatacgactcactatagggagcgcgactctaatctcgg

SEQ ID NO: 1642 - DNA, 811 bp, Nilaparvata lugens
ctgcgagtgcgcttgtccgacattgtctcgatccagccttgcccagacgtcaagtatggaaagcgtatccatgtgctgcccattgatgataccgttgagggtcttacaggaaatctgttcgaagtgtatttgaagccatacttcctggaagcatacaggccaattcacaaggatgatgcattcattgttcgcggaggtatgagagcggtcgaattcaaggtggttgaaacagatccatcgccctactgcattgtcgcgccagacaccgtcatccattgtgagggagaccccatcaaacgtgaggatgaagaagacgcagcaaacgcagtcggctacgacgacattggaggctgcagaaagcagctggcgcagatcaaagagatggtggagttgccgctgagacatcccagtctgttcaaggcgatcggcgtgaagccgccacgaggcatcctgctgtacggaccaccgggaaccggaaagacgttgatagcgcgcgccgtcgccaacgaaacgggcgccttcttcttcctcatcaacggacccgagattatgagcaaattggccggcgagtcggagagtaacctgcgcaaagctttcgaggaagcggacaaaaacgcaccggccatcatcttcatcgatgagctggacgcaatcgcgccaaaacgcgagaagacgcacggcgaggtggagcgacgcatcgtgtcgcagctgctgacgctgatggacggtctcaagcagagctcgcacgtgattgtcatggccgccaccaatcggcccaactcgatcgatgccgcgcttaggcgctttggcc

SEQ ID NO: 1643 - DNA, 41 bp, artificial sequence
  Description of artificial sequence:  synthetic primer
gcgtaatacgactcactataggctgcgagtgcgcttgtccg

SEQ ID NO: 1644 - DNA, 19 bp, artificial sequence
  Description of artificial sequence:  synthetic primer
ggccaaagcgcctaagcgc

SEQ ID NO: 1645 - DNA, 19 bp, artificial sequence
  Description of artificial sequence:  synthetic primer
ctgcgagtgcgcttgtccg

SEQ ID NO: 1646 - DNA, 41 bp, artificial sequence
  Description of artificial sequence:  synthetic primer
gcgtaatacgactcactataggggccaaagcgcctaagcgc

SEQ ID NO: 1647 - DNA, 688 bp, Nilaparvata lugens
gacgccagtatcagaagacatgcttggtcgtgtattcaacggaagtggtaagcccatcgacaaaggacctcccattcttgctgaggattatctcgacattcaaggtcaacccatcaatccttggtcgcgtatctatcccgaggaaatgatccagactggaatttcagccatcgacgtcatgaactcgattgctcgtggccagaaaatccccatcttttcagctgccggtctacctcacaacgaaattgctgctcaaatctgtagacaggctggtcttgtcaaactgccaggaaagtcagttctcgatgactctgaggacaactttgctattgtattcgcagccatgggagtcaacatggaaactgctcgattcttcaaacaggatttcgaggagaacggctctatggagaacgtgtgcctgttcttgaacctggcgaacgacccgacgatcgagcgtatcatcacaccacgcctggcgctgacggccgccgagttcctggcctaccagtgcgagaagcacgtgctcgtcatcctcaccgacatgagctcctacgccgaggcgctgcgagaggtgtccgccgcccgcgaggaggtgcccggccgtcgtggtttccccggttacatgtacaccgatctggccaccatctacgagcgcgccggacgagtcgagggtcgcaacggctccatc

SEQ ID NO: 1648 - DNA, 45 bp, artificial sequence
  Description of artificial sequence:  synthetic primer
gcgtaatacgactcactatagggacgccagtatcagaagacatgc

SEQ ID NO: 1649 - DNA, 18 bp, artificial sequence
  Description of artificial sequence:  synthetic primer
gatggagccgttgcgacc

SEQ ID NO: 1650 - DNA, 23 bp, artificial sequence
  Description of artificial sequence:  synthetic primer
gacgccagtatcagaagacatgc

SEQ ID NO: 1651 - DNA, 40 bp, artificial sequence
  Description of artificial sequence:  synthetic primer
gcgtaatacgactcactatagggatggagccgttgcgacc

SEQ ID NO: 1652 - DNA, 828 bp, Nilaparvata lugens
gcaaatgcctgtgccacgcccacaaatagaaagcacacaacagtttattcgatccgagaaaacaacatactcgaatggattcaccaccattgaggaggacttcaaagtagacactttcgaataccgtcttctgcgcgaggtgtcgttccgcgaatctctgatcagaaactacttgcacgaggcggacatgcagatgtcgacggtggtggaccgagcattgggtcccccctcggcgccacacatccagcagaagccgcgcaactcaaaaatccaggagggcggcgatgccgtcttttccatcaagctcagcgccaaccccaagcctcggctggtctggttcaagaacggtcagcgcatcggtcagacgcagaaacaccaggcctcctactccaatcagaccgccacgctcaaggtcaacaaagtcagcgctcaagactccggccactacacgctgcttgctgaaaatccgcaaggatgtactgtgtcctcagcttacctagctgtcgaatcagctggcactcaagatacaggatacagtgagcaatacagcagacaagaggtggagacgacagaggcggtggacagcagcaagatgctggcaccgaactttgttcgcgtgccggccgatcgcgacgcgagcgaaggcaagatgacgcggtttgactgccgcgtgacgggccgaccctacccggacgtggcctggttcatcaacggccaacaggtggctgacgacgccacgcacaagatcctcgtcaacgagtctggcaaccactcgctcatgatcaccggcgtcactcgcttggaccacggagtggtcggctgtattgc

SEQ ID NO: 1653 - DNA, 41 bp, artificial sequence
  Description of artificial sequence:  synthetic primer
gcgtaatacgactcactatagggcaaatgcctgtgccacgc

SEQ ID NO: 1654 - DNA, 21 bp, artificial sequence
  Description of artificial sequence:  synthetic primer
gcaatacagccgaccactccg

SEQ ID NO: 1655 - DNA, 19 bp, artificial sequence
  Description of artificial sequence:  synthetic primer
gcaaatgcctgtgccacgc

SEQ ID NO: 1656 - DNA, 43 bp, artificial sequence
  Description of artificial sequence:  synthetic primer
gcgtaatacgactcactatagggcaatacagccgaccactccg

SEQ ID NO: 1657 - DNA, 313 bp, Nilaparvata lugens
gcttcagatttgggacacggccggccaggagcggttccgcacgatcacatcgagctactaccggggcgcccacggcatcattgtggtgtacgactgcaccgaccaggagtcgttcaacaacctcaaacagtggctcgaggagattgaccgctacgcctgtgataatgtcaacaaactgctcgtcggcaacaagtgtgatcagaccaacaaaaaggtcgtcgactatacacaggctaaggaatacgccgaccagctgggcattccgttcctggagacgtcggcgaagaacgcgaccaatgtggagcaggcgttc

SEQ ID NO: 1658 - DNA, 43 bp, artificial sequence
  Description of artificial sequence:  synthetic primer
gcgtaatacgactcactatagggcttcagatttgggacacggc

SEQ ID NO: 1659 - DNA, 20 bp, artificial sequence
  Description of artificial sequence:  synthetic primer
gaacgcctgctccacattgg

SEQ ID NO: 1660 - DNA, 21 bp, artificial sequence
  Description of artificial sequence:  synthetic primer
gcttcagatttgggacacggc

SEQ ID NO: 1661 - DNA, 42 bp, artificial sequence
  Description of artificial sequence:  synthetic primer
gcgtaatacgactcactatagggaacgcctgctccacattgg

SEQ ID NO: 1662 - DNA, 443 bp, Nilaparvata lugens
cgtcagtctcaattctgtcaccgatatcagcaccacgttcattctcaagccacaagagaacgtgaagataacgcttgagggcgcacaggcctgtttcatttcacacgaacgacttgtgatctcactgaagggaggagaactctatgttctaactctctattccgatagtatgcgcagtgtgaggagttttcatctggagaaagctgctgccagtgtcttgactacttgtatctgtgtttgtgaggagaactatctgttccttggttcccgtcttggaaactcactgttgctcaggtttactgagaaggaattgaacctgattgagccgagggccatcgaaagctcacagtcccagaatccggccaagaagaaaaagctggatactttgggagattggatggcatctgacgtcactgaaatacgcgacctggatgaactagaag

SEQ ID NO: 1663 - DNA, 45 bp, artificial sequence
  Description of artificial sequence:  synthetic primer
gcgtaatacgactcactataggcgtcagtctcaattctgtcaccg

SEQ ID NO: 1664 - DNA, 22 bp, artificial sequence
  Description of artificial sequence:  synthetic primer
cttctagttcatccaggtcgcg

SEQ ID NO: 1665 - DNA, 23 bp, artificial sequence
  Description of artificial sequence:  synthetic primer
cgtcagtctcaattctgtcaccg

SEQ ID NO: 1666 - DNA, 44 bp, artificial sequence
  Description of artificial sequence:  synthetic primer
gcgtaatacgactcactataggcttctagttcatccaggtcgcg

SEQ ID NO: 1667 - DNA, 647 bp, Nilaparvata lugens
ctcacgagaggacgttgcacactgatatactgttcggtttggtgaaagatgtcgcccgattcagacctgacttgaagctgctcatatcaagcgccacactggatgctcagaaattctccgagtttttcgacgatgcacccatcttcaggattccgggccgtagatttccggtggacatctactacacaaaggcgcccgaggctgactacgtggacgcatgtgtcgtttcgatcctgcagatccacgccactcagccgctgggagacatcctggtcttcctcaccggtcaggaggagatcgaaacctgccaggagctgctgcaggacagagtgcgcaggcttgggtctcgtatcaaggagctgctcatattgcccgtctattccaacctacccagtgatatgcaggcaaagattttcctgcccactccaccaaatgctagaaaggtagtattggccacaaatattgcagaaacctcattgaccatcgacaatataatctacgtgattgatcctggtttttgtaagcagaataacttcaattcaaggactggaatggaatcgcttgttgtagtgcctgtttcaaaggcatcggccaatcagcgagcagggcgggcgggacgggtggcggccggcaagtgcttccgtctg

SEQ ID NO: 1668 - DNA, 44 bp, artificial sequence
  Description of artificial sequence:  synthetic primer
gcgtaatacgactcactataggctcacgagaggacgttgcacac

SEQ ID NO: 1669 - DNA, 19 bp, artificial sequence
  Description of artificial sequence:  synthetic primer
cagacggaagcacttgccg

SEQ ID NO: 1670 - DNA, 22 bp, artificial sequence
  Description of artificial sequence:  synthetic primer
ctcacgagaggacgttgcacac

SEQ ID NO: 1671 - DNA, 41 bp, artificial sequence
  Description of artificial sequence:  synthetic primer
gcgtaatacgactcactataggcagacggaagcacttgccg

SEQ ID NO: 1672 - DNA, 545 bp, Nilaparvata lugens
gtcctcggacgggaggtccacgtgtttaccgggattccgtttgcgaaacctcccatcggtccgttgcgattccgtaaaccggttcccgtcgacccgtggcacggcgttctggatgcgaccgcgcttcccaacagctgctaccaggaacggtacgagtatttcccgggcttcgagggagaggaaatgtggaatccgaatacgaatttgtccgaagattgtctgtatttgaacatatgggtgccgcaccggttgagaatccgacacagagccaacagcgaggagaataaaccaagagcgaaggtgccggtgctgatctggatctacggcgggggttacatgagcggcacagctacactggacgtgtacgatgctgacatggtggccgccacgagtgacgtcatcgtcgcctccatgcagtaccgagtgggtgcgttcggcttcctctacctcgcacaggacttgcctcgaggcagcgaggaggcgccgggcaacatggggctctgggaccaggcccttgccatccgctggctcaaggacaacattgc

SEQ ID NO: 1673 - DNA, 41 bp, artificial sequence
  Description of artificial sequence:  synthetic primer
gcgtaatacgactcactatagggtcctcggacgggaggtcc

SEQ ID NO: 1674 - DNA, 22 bp, artificial sequence
  Description of artificial sequence:  synthetic primer
gcaatgttgtccttgagccagc

SEQ ID NO: 1675 - DNA, 19 bp, artificial sequence
  Description of artificial sequence:  synthetic primer
gtcctcggacgggaggtcc

SEQ ID NO: 1676 - DNA, 44 bp, artificial sequence
  Description of artificial sequence:  synthetic primer
gcgtaatacgactcactatagggcaatgttgtccttgagccagc

SEQ ID NO: 1677 - DNA, 850 bp, Nilaparvata lugens; identical to SEQ ID NO: 1113

SEQ ID NO: 1678 - DNA, 40 bp, artificial sequence
  Description of artificial sequence:  synthetic primer
gcgtaatacgactcactataggagaagacggcacggtgcg

SEQ ID NO: 1679 - DNA, 25 bp, artificial sequence
  Description of artificial sequence:  synthetic primer
caatccagtttttacagtttcgtgc

SEQ ID NO: 1680 - DNA, 18 bp, artificial sequence
  Description of artificial sequence:  synthetic primer
agaagacggcacggtgcg

SEQ ID NO: 1681 - DNA, 47 bp, artificial sequence
  Description of artificial sequence:  synthetic primer
gcgtaatacgactcactataggcaatccagtttttacagtttcgtgc

SEQ ID NO: 1682 - DNA, 655 bp, Chilo suppressalis
taaagcatggatgttggacaaactgggtggcgtgtacgcgccgcggccgtcgaccggcccccacaagttgcgcgagtgcctgccgctggtgatcttcctcaggaaccggctcaagtacgcgctcaccggaaatgaagtgcttaagattgtaaagcagcgacttatcaaagttgacggcaaagtcaggacagaccccacatatcccgctggatttatggatgttgtttccattgaaaagacaaatgagctgttccgtcttatatatgatgtcaaaggcagatttactattcaccgtattactcctgaggaggctaaatacaagctgtgcaaggtgcggcgcgtggcgacgggccccaagaacgtgccttacctggtgacccacgacggacgcaccgtgcgataccccgacccactcatcaaggtcaacgactccatccagctcgacatcgccacctccaagatcatggacttcatcaagtttgaatctggtaacctatgtatgatcacgggaggccgtaacttggggcgcgtgggcaccatcgtgtcccgcgagcgacatcccgggtccttcgacatcgtgcatatacgggactccaccggacataccttcgctaccagattgaacaacgtgttcataatcggcaagggcacgaag

SEQ ID NO: 1683 - protein, 232 aa, Chilo suppressalis
KAWMLDKLGGVYAPRPSTGPHKLRECLPLVIFLRNRLKYALTGNEVLKIVKQRLIKVDGKVRTDPTYPAGFMDVVSIEKTNELFRLIYDVKGRFTIHRITPEEAKYKLCKVRRVATGPKNVPYLVTHDGRTVRYPDPLIKVNDSIQLDIATSKIMDFIKFESGNLCMITGGRNLGRVGTIVSRERHPGSFDIVHIRDSTGHTFATRLNNVFIIGKGTKAYISLPRGKGVRLT

SEQ ID NO: 1684 - DNA, 396 bp, Chilo suppressalis
gagtttctttagtaaagtattcggtggcaagaaggaggagaagggtccatcaacacacgaagctatacagaaattacgcgaaacggaagagttattgcagaagaaacaagagtttctagagcgaaagatcgacactgaattacaaacggcgagaaaacatggcacaaagaataagagagctgccattgcggcactgaagcgcaagaagcgttatgaaaagcagcttacccagattgatggcacgcttacccaaattgaggcccaaagggaagcgctagaaggagctaacaccaatacacaggtgcttaacactatgcgagatgctgctaccgctatgagactcgcccacaaggatatcgatgtagacaaggtacacgatctgatggatgacattgc

SEQ ID NO: 1685 - protein, 131 aa, Chilo suppressalis
SFFSKVFGGKKEEKGPSTHEAIQKLRETEELLQKKQEFLERKIDTELQTARKHGTKNKRAAIAALKRKKRYEKQLTQIDGTLTQIEAQREALEGANTNTQVLNTMRDAATAMRLAHKDIDVDKVHDLMDDI

SEQ ID NO: 1686 - DNA, 406 bp, Chilo suppressalis
tggtctccgcaacaagcgtgaggtgtggagggtgaagtacacgctggccaggatccgtaaggctgcccgtgagctgctcacactcgaggagaaagaccctaagaggttattcgaaggtaatgctctccttcgtcgtctggtgaggatcggtgtgttggatgagaagcagatgaagctcgattatgtactcggtctgaagattgaggacttcttggaacgtcgtctccagactcaggtgttcaaggctggtctagctaagtctatccatcatgcccgtattcttatcagacagaggcacatccgtgtccgcaagcaagttgtgaacatcccttcgttcatcgtgcggctggactctggcaagcacattgacttctcgctgaagtctccgttcggcggcggccggccg

SEQ ID NO: 1687 - protein, 135 aa, Chilo suppressalis
GLRNKREVWRVKYTLARIRKAARELLTLEEKDPKRLFEGNALLRRLVRIGVLDEKQMKLDYVLGLKIEDFLERRLQTQVFKAGLAKSIHHARILIRQRHIRVRKQVVNIPSFIVRLDSGKHIDFSLKSPFGGGRP

SEQ ID NO: 1688 - DNA, 530 bp, Chilo suppressalis
acctgccaaggaatgaggaacgctttgtatgacaaattggatgatgatggtataattgcaccagggattcgtgtatctggtgacgatgtagtcattggaaaaactataactttgccagaaaacgatgatgagctggaaggaacatcaagacgatacagtaagagagatgcctctacattcttgcgaaacagtgaaactggtattgttgaccaagttatgcttacacttaacagcgaaggatacaaattttgtaaaatacgtgtgagatctgtgagaatcccacaaattggagacaaatttgcttctcgtcatggtcaaaaagggacttgtggtattcaatataggcaagaagatatgcctttcacttgtgaaggattgacaccagatattatcatcaatccacatgctatcccctctcgtatgacaattggtcacttgattgaatgtattcaaggtaaggtctcctcaaataaaggtgaaataggtgatgctacaccatttaacgatgctgtcaacgtgcagaagatctc

SEQ ID NO: 1689 - protein, 176 aa, Chilo suppressalis
TCQGMRNALYDKLDDDGIIAPGIRVSGDDVVIGKTITLPENDDELEGTSRRYSKRDASTFLRNSETGIVDQVMLTLNSEGYKFCKIRVRSVRIPQIGDKFASRHGQKGTCGIQYRQEDMPFTCEGLTPDIIINPHAIPSRMTIGHLIECIQGKVSSNKGEIGDATPFNDAVNVQKI

SEQ ID NO: 1690 - DNA, 959 bp, Chilo suppressalis
tttcagagatttcttgttggaaccagagattttgggggctatcgtcgattgcggtttcgagcacccttcagaagttcaacatgaatgtattccccaagctgttttgggaatggatattctttgtcaaagctaaatccggaatgggaaaaaccgccgtatttgttttagcaacactgcaacagctagaaccttcagaaaaccatgtttacgtattagtaatgtgccatacaagggaactcgctttccaaataagcaaggaatatgagaggttctctaaatatatggctggtgttagagtatctgtattctttggtgggatgccaattcagaaagatgaagaagtattgaagacagcctgcccgcacatcgttgttggtactcctggcagaatattagcattggttaacaacaagaaactgaatttaaaacacctgaaacacttcatcctggatgaatgtgacaaaatgcttgaatctctagacatgagacgtgatgtgcaggaaatattcaggaacacccctcacggtaagcaggtcatgatgttttctgcaacattgagtaaggagatcagaccagtctgtaagaaatttatgcaagatcctatggaagtttatgtggatgatgaagctaaacttacattgcacggtttgcagcaacattatgttaaactcaaggaaaatgaaaagaataagaagttatttgaacttttggatgtactggagttcaaccaagttgtcatatttgtaaagtcagtgcagcgctgcatagctctcgcacagctgctgacagaccaaaacttcccagctattggtatacaccgaaatatgactcaagatgagcgtctctcccgctatcagcagttcaaagatttccagaagaggatccttgttgcgacaaatctttttggacggggtatggacattgaaagagtcaacatagtcttcaattatgacatgccg

SEQ ID NO: 1691 - protein, 319 aa, Chilo suppressalis
SEISCWNQRFWGLSSIAVSSTLQKFNMNVFPKLFWEWIFFVKAKSGMGKTAVFVLATLQQLEPSENHVYVLVMCHTRELAFQISKEYERFSKYMAGVRVSVFFGGMPIQKDEEVLKTACPHIVVGTPGRILALVNNKKLNLKHLKHFILDECDKMLESLDMRRDVQEIFRNTPHGKQVMMFSATLSKEIRPVCKKFMQDPMEVYVDDEAKLTLHGLQQHYVKLKENEKNKKLFELLDVLEFNQVVIFVKSVQRCIALAQLLTDQNFPAIGIHRNMTQDERLSRYQQFKDFQKRILVATNLFGRGMDIERVNIVFNYDMP

SEQ ID NO: 1692 - DNA, 542 bp, Chilo suppressalis
cctcgttgccatttgtatttggacgtttctgcagcggctggactcacgggagcccatgtggcagctggacgagagcatcatcggcaccaaccccgggctcggcttccggcccacgccgccagaggtcgccagcagcgtcatctggtataaaggcaacgaccccaacagccaacaattctgggtgcaagaaacctccaactttctaaccgcgtacaaacgagacggtaagaaagcaggagcaggccagaacatccacaactgtgatttcaaactgcctcctccggccggtaaggtgtgcgacgtggacatcagcgcctggagtccctgtgtagaggacaagcactttggataccacaagtccacgccctgcatcttcctcaaactcaacaagatcttcggctggaggccgcacttctacaacagctccgacagcctgcccactgacatgcccgacgacttgaaggagcacatcaggaatatgacagcgtacgataagaattatctaaacatggtatgggtgtcttgcgagggagagaatccag

SEQ ID NO: 1693 - protein, 180 aa, Chilo suppressalis
LVAICIWTFLQRLDSREPMWQLDESIIGTNPGLGFRPTPPEVASSVIWYKGNDPNSQQFWVQETSNFLTAYKRDGKKAGAGQNIHNCDFKLPPPAGKVCDVDISAWSPCVEDKHFGYHKSTPCIFLKLNKIFGWRPHFYNSSDSLPTDMPDDLKEHIRNMTAYDKNYLNMVWVSCEGENP

SEQ ID NO: 1694 - DNA, 495 bp, Chilo suppressalis
ggctccggcaagacgacctttgtcaaacgacacttgactggagagttcgagaaaagatatgtcgccacattaggtgtcgaggtgcatcccttagtattccacacaaatagaggccctataaggtttaatgtatgggatactgctggccaagaaaagtttggtggtctccgagatggttactatatccaaggtcaatgtgccatcatcatgttcgatgtaacgtctcgtgtcacctacaaaaatgtacccaactggcacagagatttagtgcgagtctgtgaaggcattccaattgttctttgtggcaacaaagtagatatcaaggacagaaaagtcaaagcaaaaactattgttttccacagaaaaaagaaccttcagtattatgacatctctgccaagtcaaactacaatttcgagaaacccttcctctggttagcgagaaagttgatcggtgatggtaacctagagtttgtcgccatgcagccctgcttccac

SEQ ID NO: 1695 - protein, 165 aa, Chilo suppressalis
GSGKTTFVKRHLTGEFEKRYVATLGVEVHPLVFHTNRGPIRFNVWDTAGQEKFGGLRDGYYIQGQCAIIMFDVTSRVTYKNVPNWHRDLVRVCEGIPIVLCGNKVDIKDRKVKAKTIVFHRKKNLQYYDISAKSNYNFEKPFLWLARKLIGDGNLEFVAMQPCFH

SEQ ID NO: 1696 - DNA, 401 bp, Chilo suppressalis
cagatgcgcccgttgttgatactgccgaacaggtatacatctcgtctttggccctgttgaagatgttaaaacacgggcgcgccggtgttccaatggaagttatgggacttatgttaggtgaatttgttgatgattacacggtgcgtgtcatagacgtatttgccatgcctcaaactggcacaggagtgtcggttgaagctgtagatcctgtcttccaagcaaagatgttggatatgttgaagcaaactggacgacctgagatggtagtgggatggtaccactcgcatcctggctttggatgttggttatctggagtcgacattaatactcagcagtctttcgaagctttgtctgaacgtgctgtagctgtagtggttgatcccattcagtctgtcaagggc

SEQ ID NO: 1697 - protein, 133 aa, Chilo suppressalis
DAPVVDTAEQVYISSLALLKMLKHGRAGVPMEVMGLMLGEFVDDYTVRVIDVFAMPQTGTGVSVEAVDPVFQAKMLDMLKQTGRPEMVVGWYHSHPGFGCWLSGVDINTQQSFEALSERAVAVVVDPIQSVKG

SEQ ID NO: 1698 - DNA, 626 bp, Chilo suppressalis
ttcaaaagcagatcaagcatatgatggccttcatcgaacaagaggctaatgaaaaggccgaggaaatcgatgcaaaggccgaagaggagttcaacattgaaaaaggccgcctggtgcagcagcagcggctcaagatcatggaatactacgaaaagaaagagaaacaagtggaactccagaaaaagatccaatcttcgaacatgctgaatcaagcccgtctgaaggtgctcaaagtgcgtgaggaccacgtacgcaacgttctcgacgaggctcgcaagcgcctggctgaggtgcccaaagacgtgaaactttacacagatctgctggtcacgctcgtcgtacaagccctattccagctcatggaacccacagtaacagttcgcgttaggcaggcggacgtctccttagtacagtccatattgggcaaggcacagcaggattacaaagcaaagatcaagaaggacgttcaattgaagatcgacaccgagaattccctgcccgccgatacttgtggcggagtggaacttattgctgctagagggcgtattaagatcagcaacactctggagtctcgtctggagctgatagcccaacaactgttgcccgaaatacgtaccgcattgttc

SEQ ID NO: 1699 - protein, 208 aa, Chilo suppressalis
QKQIKHMMAFIEQEANEKAEEIDAKAEEEFNIEKGRLVQQQRLKIMEYYEKKEKQVELQKKIQSSNMLNQARLKVLKVREDHVRNVLDEARKRLAEVPKDVKLYTDLLVTLVVQALFQLMEPTVTVRVRQADVSLVQSILGKAQQDYKAKIKKDVQLKIDTENSLPADTCGGVELIAARGRIKISNTLESRLELIAQQLLPEIRTALF

SEQ ID NO: 1700 - DNA, 864 bp, Chilo suppressalis
atcgtgctttcagacgataactgccccgatgagaagatccgcatgaaccgcgtcgtgcgaaacaacttgcgtgtacgcctgtcagacatagtctccatagcgccttgtccatcggtcaaatatgggaaacgggtacatatattgcccattgatgattctgtcgagggtttgactggaaatttattcgaagtctacttgaaaccatacttcatggaagcttatcggcctatccatcgcgatgacacattcatggttcgcgggggcatgagggctgttgaattcaaagtggtggagactgatccgtcgccgtattgcatcgtcgctcccgacacagtgatacactgcgaaggagaccctatcaaacgagaggaagaagaagaagccctaaacgccgtagggtacgacgacatcggtggctgtcgtaaacagctcgctcagatcaaagagatggtcgagttgcctctaaggcatccgtcgctgttcaaggcaattggtgtgaagccgccacgtggaatcctcatgtatgggccgcctggtaccggcaaaactctcattgctcgggcagtggctaatgaaactggtgcattcttctttctgatcaacgggccggagatcatgtccaaactcgcgggcgagtccgaatcgaaccttcgcaaggcattcgaggaagcggacaagaactccccggctataatcttcatcgatgaactggatgccatcgcaccaaagagggagaagactcacggtgaagtggagcgtcgtattgtgtcgcaactacttactcttatggatggaatgaagaagtcatcgcacgtgatcgtaatggccgccaccaaccgtccgaattcgatcgacccggcgcta

SEQ ID NO: 1701 - protein, 288 aa, Chilo suppressalis
IVLSDDNCPDEKIRMNRVVRNNLRVRLSDIVSIAPCPSVKYGKRVHILPIDDSVEGLTGNLFEVYLKPYFMEAYRPIHRDDTFMVRGGMRAVEFKVVETDPSPYCIVAPDTVIHCEGDPIKREEEEEALNAVGYDDIGGCRKQLAQIKEMVELPLRHPSLFKAIGVKPPRGILMYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPAL

SEQ ID NO: 1702 - DNA, 1144 bp, Chilo suppressalis
aggatggaagcggggatacgtttgagcatctccttggggaagatacggagcagctgccagccgatgtccagcgactcgaatactgtgcggttctcgtagttgccctgtgtgatgaagttcttctcgaacttggtgaggaactcgaggtagagcagatcgtcgggtgtcagggcttcctcaccgacgacagccttcatggcctgcacgtccttaccgatggcgtagcaggcgtacagctggttggaaacatcagagtggtccttgcgggtcattccctcaccgatggcagacttcatgagacgagacagggaaggcagcacgtttacaggcgggtagatctgtctgttgtggagctgacggtctacgtagatctgtccctcagtgatgtagcccgttaaatcgggaataggatgggtgatgtcgtcgttgggcatagtcaagatggggatctgcgtgatggatccgtttctaccctctacacgcccggctctctcgtagatggtggccaaatcggtgtacatgtaacctgggaaaccacgtcgtccgggcacctcctcacgggcggcggacacttcacgcagagcctccgcgtacgaagacatgtcagtcaagattaccagcacgtgtttctcacactggtaggccaagaactcagcagcagtcaaggccaaacgtggtgtgatgattctctcaatagtgggatcgttggccagattcaagaacaggcacacgttctccatggagccgttctcctcgaagtcctgcttgaagaaccgggccgtctccatgttcacacccatggcggcgaacacgatggcaaagttgtcctcgtggtcgtccagcacagatttgccggggatctttacaagaccggcttgcctacagatctgggcggcaatttcgttgtgtggcagaccggcagccgagaaaatggggatcttttgcccgcgagcaatggagttcatcacgtcgatagcggagataccagtctggatcatttcctcagggtagatacgggaccaggggttgatgggctgtccctggatgtccaaaaagtcttcagcaaggattgggggacctttgtcaatgggttttccagagccgttgaatacgcgacccaacatgtcttcggagacaggggtgc

SEQ ID NO: 1703 - protein, 380 aa, Chilo suppressalis
TPVSEDMLGRVFNGSGKPIDKGPPILAEDFLDIQGQPINPWSRIYPEEMIQTGISAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFITQGNYENRTVFESLDIGWQLLRIFPKEMLKRIPASI

SEQ ID NO: 1704 - DNA, 1225 bp, Chilo suppressalis
gctccgtctacattcagccggaaggcgtccctgtacctgctcagcaatcccaacagcagcagagttaccgccacgtcagcgagagcgtcgaacacaaatcctacggcacgcaagggtacaccacttcggaacagaccaagcagacacagaaggtggcgtacaccaacggttccgactactcttccacggacgactttaaggtggatacgttcgaatacagactcctccgagaagtttcgttcagggaatccatcacgaagcggtacattggcgagacagacattcagatcagcacggaggtcgacaagtctctcggtgtggtgacccctcctaagatagcacaaaagcctaggaattccaagctgcaggagggagccgacgctcagtttcaagtgcagctgtcgggtaacccgcggccacgggtgtcatggttcaagaacgggcagaggatagtcaactcgaacaaacacgaaatcgtcacgacacataatcaaacaatacttagggtaagaaacacacaaaagtctgatactggcaactacacgttgttggctgaaaatcctaacggatgcgtcgtcacatcggcatacctggccgtggagtcgcctcaagaaacttacggccaagatcataaatcacaatacataatggacaatcagcaaacagctgtagaagaaagagtagaagttaatgaaaaagctctcgctccgcaattcgtaagagtctgccaagaccgcgatgtaacggaggggaaaatgacgcgattcgattgccgcgtcacgggcagaccttacccagaagtcacgtggttcattaacgatagacaaattcgagacgattatwatcataagatattagtaaacgaatcgtgtaatcatgcacttatgattacaaacgtcgatctcagtgatagtggcgtagtatcatgtatagcacgcaacaagaccggcgaaacttcgtttcagtgtaggctgaacgtgatagagaaggagcaagtggtcgctcccaaattcgtggagcggttcagcacgctcaacgtgcgcgagggcgagcccgtgcagctgcacgcgcgcgccgtcggcacgcctacgccacgcatcacatggcagaaggacggcgttcaagttatacccaatccagagctacgaataaataccgaaggtggggcctcgacgctggacatccctcgagccaaggcgtcggacgcgggatggtaccgatgcac

SEQ ID NO: 1705 - protein, 407 aa, Chilo suppressalis
  misc_feature (281)..(281): Xaa can be any naturally occurring amino acid
SVYIQPEGVPVPAQQSQQQQSYRHVSESVEHKSYGTQGYTTSEQTKQTQKVAYTNGSDYSSTDDFKVDTFEYRLLREVSFRESITKRYIGETDIQISTEVDKSLGVVTPPKIAQKPRNSKLQEGADAQFQVQLSGNPRPRVSWFKNGQRIVNSNKHEIVTTHNQTILRVRNTQKSDTGNYTLLAENPNGCVVTSAYLAVESPQETYGQDHKSQYIMDNQQTAVEERVEVNEKALAPQFVRVCQDRDVTEGKMTRFDCRVTGRPYPEVTWFINDRQIRDDYXHKILVNESCNHALMITNVDLSDSGVVSCIARNKTGETSFQCRLNVIEKEQVVAPKFVERFSTLNVREGEPVQLHARAVGTPTPRITWQKDGVQVIPNPELRINTEGGASTLDIPRAKASDAGWYRC

SEQ ID NO: 1706 - DNA, 23 bp, artificial sequence
  Description of artificial sequence:  synthetic primer
catttgaagcgtttwrmygcycc

SEQ ID NO: 1707 - DNA, 28 bp, artificial sequence
  Description of artificial sequence:  synthetic primer
cttcgtgcccttgccratkatraabacg

SEQ ID NO: 1708 - DNA, 27 bp, artificial sequence
  Description of artificial sequence:  synthetic primer
gagtttctttagtaaagtattcggtgg

SEQ ID NO: 1709 - DNA, 26 bp, artificial sequence
  Description of artificial sequence:  synthetic primer
gcaatgtcatccatcakrtcrtgtac

SEQ ID NO: 1710 - DNA, 26 bp, artificial sequence
  Description of artificial sequence:  synthetic primer
caggagttgarrathatygghsarta

SEQ ID NO: 1711 - DNA, 24 bp, artificial sequence
  Description of artificial sequence:  synthetic primer
caggttcttcctcttkacrcgdcc

SEQ ID NO: 1712 - DNA, 23 bp, artificial sequence
  Description of artificial sequence:  synthetic primer
acctgccaaggaatgmgvaaygc

SEQ ID NO: 1713 - DNA, 26 bp, artificial sequence
  Description of artificial sequence:  synthetic primer
gagatcttctgcacrttkacvgcatc

SEQ ID NO: 1714 - DNA, 22 bp, artificial sequence
  Description of artificial sequence:  synthetic primer
cggtgtccattcacagytccgg

SEQ ID NO: 1715 - DNA, 26 bp, artificial sequence
  Description of artificial sequence:  synthetic primer
cgatgcaagtaggtgtckgartcytc

SEQ ID NO: 1716 - DNA, 22 bp, artificial sequence
  Description of artificial sequence:  synthetic primer
cctcgttgccatytgywtktgg

SEQ ID NO: 1717 - DNA, 26 bp, artificial sequence
  Description of artificial sequence:  synthetic primer
ctggattctctccctcgcamgahacc

SEQ ID NO: 1718 - DNA, 24 bp, artificial sequence
  Description of artificial sequence:  synthetic primer
ggctccggcaagacvacmttygtc

SEQ ID NO: 1719 - DNA, 25 bp, artificial sequence
  Description of artificial sequence:  synthetic primer
gtggaagcagggcwggcatkgcrac

SEQ ID NO: 1720 - DNA, 24 bp, artificial sequence
  Description of artificial sequence:  synthetic primer
ggatcgtctgctamgwytwggagg

SEQ ID NO: 1721 - DNA, 21 bp, artificial sequence
  Description of artificial sequence:  synthetic primer
ctatggtgtccagcatsgcgc

SEQ ID NO: 1722 - DNA, 22 bp, artificial sequence
  Description of artificial sequence:  synthetic primer
atggcactgagcgaygchgatg

SEQ ID NO: 1723 - DNA, 24 bp, artificial sequence
  Description of artificial sequence:  synthetic primer
gaacttgcggttgabgttscgdcc

SEQ ID NO: 1724 - DNA, 20 bp, artificial sequence
  Description of artificial sequence:  synthetic primer
gccgcaaggagacbgtvtgc

SEQ ID NO: 1725 - DNA, 23 bp, artificial sequence
  Description of artificial sequence:  synthetic primer
cgatcaaagcgwccraavcgacg

SEQ ID NO: 1726 - DNA, 21 bp, artificial sequence
  Description of artificial sequence:  synthetic primer
gttcaccggcgayatyctgcg

SEQ ID NO: 1727 - DNA, 21 bp, artificial sequence
  Description of artificial sequence:  synthetic primer
gtcgcgcaggtagaaytckgc

SEQ ID NO: 1728 - DNA, 25 bp, artificial sequence
  Description of artificial sequence:  synthetic primer
  misc_feature (20)..(20): n is a, c, g, or t
gctccgtctacathcarccngargg

SEQ ID NO: 1729 - DNA, 23 bp, artificial sequence
  Description of artificial sequence:  synthetic primer
gtgcatcggtaccahschgcrtc

SEQ ID NO: 1730 - DNA, 21 bp, Chilo suppressalis
aaagcatggatgttggacaaa

SEQ ID NO: 1731 - DNA, 23 bp, Chilo suppressalis
aaagcatggatgttggacaaact

SEQ ID NO: 1732 - DNA, 23 bp, Chilo suppressalis
aaccggctcaagtacgcgctcac

SEQ ID NO: 1733 - DNA, 26 bp, Chilo suppressalis
aaccggctcaagtacgcgctcaccgg

SEQ ID NO: 1734 - DNA, 23 bp, Chilo suppressalis
aagatcatggacttcatcaagtt

SEQ ID NO: 1735 - DNA, 23 bp, Chilo suppressalis
accagattgaacaacgtgttcat

SEQ ID NO: 1736 - DNA, 26 bp, Chilo suppressalis
atcatggacttcatcaagtttgaatc

SEQ ID NO: 1737 - DNA, 24 bp, Chilo suppressalis
caagatcatggacttcatcaagtt

SEQ ID NO: 1738 - DNA, 21 bp, Chilo suppressalis
ccccacaagttgcgcgagtgc

SEQ ID NO: 1739 - DNA, 23 bp, Chilo suppressalis
cccgctggatttatggatgttgt

SEQ ID NO: 1740 - DNA, 28 bp, Chilo suppressalis
cctccaagatcatggacttcatcaagtt

SEQ ID NO: 1741 - DNA, 21 bp, Chilo suppressalis
cctgccgctggtgatcttcct

SEQ ID NO: 1742 - DNA, 22 bp, Chilo suppressalis
cgacgggccccaagaacgtgcc

SEQ ID NO: 1743 - DNA, 21 bp, Chilo suppressalis
ctcatcaaggtcaacgactcc

SEQ ID NO: 1744 - DNA, 35 bp, Chilo suppressalis
ctcatcaaggtcaacgactccatccagctcgacat

SEQ ID NO: 1745 - DNA, 43 bp, Chilo suppressalis
ctcatcaaggtcaacgactccatccagctcgacatcgccacct

SEQ ID NO: 1746 - DNA, 21 bp, Chilo suppressalis
ctgccgctggtgatcttcctc

SEQ ID NO: 1747 - DNA, 23 bp, Chilo suppressalis
gaccccacatatcccgctggatt

SEQ ID NO: 1748 - DNA, 21 bp, Chilo suppressalis
gcagcgacttatcaaagttga

SEQ ID NO: 1749 - DNA, 23 bp, Chilo suppressalis
gcatggatgttggacaaactggg

SEQ ID NO: 1750 - DNA, 26 bp, Chilo suppressalis
gccacctccaagatcatggacttcat

SEQ ID NO: 1751 - DNA, 30 bp, Chilo suppressalis
gcgcgtggcgacgggccccaagaacgtgcc

SEQ ID NO: 1752 - DNA, 22 bp, Chilo suppressalis
gctggatttatggatgttgttt

SEQ ID NO: 1753 - DNA, 22 bp, Chilo suppressalis
ggctcaagtacgcgctcaccgg

SEQ ID NO: 1754 - DNA, 24 bp, Chilo suppressalis
gtgggcaccatcgtgtcccgcgag

SEQ ID NO: 1755 - DNA, 26 bp, Chilo suppressalis
gtgggcaccatcgtgtcccgcgagcg

SEQ ID NO: 1756 - DNA, 35 bp, Chilo suppressalis
gtgggcaccatcgtgtcccgcgagcgacatcccgg

SEQ ID NO: 1757 - DNA, 21 bp, Chilo suppressalis
taaagcatggatgttggacaa

SEQ ID NO: 1758 - DNA, 22 bp, Chilo suppressalis
taaagcatggatgttggacaaa

SEQ ID NO: 1759 - DNA, 24 bp, Chilo suppressalis
taaagcatggatgttggacaaact

SEQ ID NO: 1760 - DNA, 27 bp, Chilo suppressalis
taaagcatggatgttggacaaactggg

SEQ ID NO: 1761 - DNA, 38 bp, Chilo suppressalis
tacaagctgtgcaaggtgcggcgcgtggcgacgggccc

SEQ ID NO: 1762 - DNA, 41 bp, Chilo suppressalis
tacaagctgtgcaaggtgcggcgcgtggcgacgggccccaa

SEQ ID NO: 1763 - DNA, 23 bp, Chilo suppressalis
taccccgacccactcatcaaggt

SEQ ID NO: 1764 - DNA, 22 bp, Chilo suppressalis
tgaacaacgtgttcataatcgg

SEQ ID NO: 1765 - DNA, 22 bp, Chilo suppressalis
tgcgcgagtgcctgccgctggt

SEQ ID NO: 1766 - DNA, 29 bp, Chilo suppressalis
tgtatgatcacgggaggccgtaacttggg

SEQ ID NO: 1767 - DNA, 32 bp, Chilo suppressalis
tgtatgatcacgggaggccgtaacttggggcg

SEQ ID NO: 1768 - DNA, 57 bp, Chilo suppressalis
tgtatgatcacgggaggccgtaacttggggcgcgtgggcaccatcgtgtcccgcgag

SEQ ID NO: 1769 - DNA, 35 bp, Chilo suppressalis
tgtgcaaggtgcggcgcgtggcgacgggccccaag

SEQ ID NO: 1770 - DNA, 35 bp, Chilo suppressalis
ttgaacaacgtgttcataatcggcaagggcacgaa

SEQ ID NO: 1771 - DNA, 29 bp, Chilo suppressalis
attgaggcccaaagggaagcgctagaagg

SEQ ID NO: 1772 - DNA, 22 bp, Chilo suppressalis
cacgatctgatggatgacattg

SEQ ID NO: 1773 - DNA, 27 bp, Chilo suppressalis
gagtttctttagtaaagtattcggtgg

SEQ ID NO: 1774 - DNA, 23 bp, Chilo suppressalis
tatgaaaagcagcttacccagat

SEQ ID NO: 1775 - DNA, 23 bp, Chilo suppressalis
aggcacatccgtgtccgcaagca

SEQ ID NO: 1776 - DNA, 21 bp, Chilo suppressalis
aagattgaggacttcttggaa

SEQ ID NO: 1777 - DNA, 23 bp, Chilo suppressalis
aagcacattgacttctcgctgaa

SEQ ID NO: 1778 - DNA, 23 bp, Chilo suppressalis
atcagacagaggcacatccgtgt

SEQ ID NO: 1779 - DNA, 21 bp, Chilo suppressalis
atccgtaaggctgcccgtgag

SEQ ID NO: 1780 - DNA, 24 bp, Chilo suppressalis
atccgtaaggctgcccgtgagctg

SEQ ID NO: 1781 - DNA, 26 bp, Chilo suppressalis
atccgtaaggctgcccgtgagctgct

SEQ ID NO: 1782 - DNA, 29 bp, Chilo suppressalis
atccgtaaggctgcccgtgagctgctcac

SEQ ID NO: 1783 - DNA, 22 bp, Chilo suppressalis
cacatccgtgtccgcaagcaag

SEQ ID NO: 1784 - DNA, 23 bp, Chilo suppressalis
cacatccgtgtccgcaagcaagt

SEQ ID NO: 1785 - DNA, 25 bp, Chilo suppressalis
cacatccgtgtccgcaagcaagttg

SEQ ID NO: 1786 - DNA, 21 bp, Chilo suppressalis
cgcaacaagcgtgaggtgtgg

SEQ ID NO: 1787 - DNA, 29 bp, Chilo suppressalis
cgtgtccgcaagcaagttgtgaacatccc

SEQ ID NO: 1788 - DNA, 30 bp, Chilo suppressalis
ctcgctgaagtctccgttcggcggcggccg

SEQ ID NO: 1789 - DNA, 23 bp, Chilo suppressalis
ctcggtctgaagattgaggactt

SEQ ID NO: 1790 - DNA, 29 bp, Chilo suppressalis
ctggactctggcaagcacattgacttctc

SEQ ID NO: 1791 - DNA, 32 bp, Chilo suppressalis
gacttctcgctgaagtctccgttcggcggcgg

SEQ ID NO: 1792 - DNA, 35 bp, Chilo suppressalis
gacttctcgctgaagtctccgttcggcggcggccg

SEQ ID NO: 1793 - DNA, 35 bp, Chilo suppressalis
gaggagaaagaccctaagaggttattcgaaggtaa

SEQ ID NO: 1794 - DNA, 21 bp, Chilo suppressalis
gatccgtaaggctgcccgtga

SEQ ID NO: 1795 - DNA, 27 bp, Chilo suppressalis
gatccgtaaggctgcccgtgagctgct

SEQ ID NO: 1796 - DNA, 32 bp, Chilo suppressalis
gattatgtactcggtctgaagattgaggactt

SEQ ID NO: 1797 - DNA, 26 bp, Chilo suppressalis
ggtctgaagattgaggacttcttgga

SEQ ID NO: 1798 - DNA, 23 bp, Chilo suppressalis
gtgtggagggtgaagtacacgct

SEQ ID NO: 1799 - DNA, 26 bp, Chilo suppressalis
gtgttcaaggctggtctagctaagtc

SEQ ID NO: 1800 - DNA, 35 bp, Chilo suppressalis
gtgttggatgagaagcagatgaagctcgattatgt

SEQ ID NO: 1801 - DNA, 22 bp, Chilo suppressalis
tgaagattgaggacttcttgga

SEQ ID NO: 1802 - DNA, 28 bp, Chilo suppressalis
tggactctggcaagcacattgacttctc

SEQ ID NO: 1803 - DNA, 22 bp, Chilo suppressalis
tggatgagaagcagatgaagct

SEQ ID NO: 1804 - DNA, 24 bp, Chilo suppressalis
tggtctccgcaacaagcgtgaggt

SEQ ID NO: 1805 - DNA, 28 bp, Chilo suppressalis
tggtctccgcaacaagcgtgaggtgtgg

SEQ ID NO: 1806 - DNA, 26 bp, Chilo suppressalis
cgtatgacaattggtcacttgattga

SEQ ID NO: 1807 - DNA, 26 bp, Chilo suppressalis
gaagatatgcctttcacttgtgaagg

SEQ ID NO: 1808 - DNA, 26 bp, Chilo suppressalis
ggaaaaactataactttgccagaaaa

SEQ ID NO: 1809 - DNA, 29 bp, Chilo suppressalis
ggtgatgctacaccatttaacgatgctgt

SEQ ID NO: 1810 - DNA, 26 bp, Chilo suppressalis
tctcgtatgacaattggtcacttgat

SEQ ID NO: 1811 - DNA, 22 bp, Chilo suppressalis
ctgtcaacgtgcagaagatctc

SEQ ID NO: 1812 - DNA, 26 bp, Chilo suppressalis
tggatgaatgtgacaaaatgcttgaa

SEQ ID NO: 1813 - DNA, 23 bp, Chilo suppressalis
tttatgcaagatcctatggaagt

SEQ ID NO: 1814 - DNA, 32 bp, Chilo suppressalis
aaatttatgcaagatcctatggaagtttatgt

SEQ ID NO: 1815 - DNA, 23 bp, Chilo suppressalis
aatatgactcaagatgagcgtct

SEQ ID NO: 1816 - DNA, 26 bp, Chilo suppressalis
atgactcaagatgagcgtctctcccg

SEQ ID NO: 1817 - DNA, 23 bp, Chilo suppressalis
atgcaagatcctatggaagttta

SEQ ID NO: 1818 - DNA, 26 bp, Chilo suppressalis
atgcaagatcctatggaagtttatgt

SEQ ID NO: 1819 - DNA, 30 bp, Chilo suppressalis
cgctatcagcagttcaaagatttccagaag

SEQ ID NO: 1820 - DNA, 21 bp, Chilo suppressalis
gaaaatgaaaagaataagaag

SEQ ID NO: 1821 - DNA, 23 bp, Chilo suppressalis
gaagttcaacatgaatgtattcc

SEQ ID NO: 1822 - DNA, 23 bp, Chilo suppressalis
gatgagcgtctctcccgctatca

SEQ ID NO: 1823 - DNA, 25 bp, Chilo suppressalis
tgccaattcagaaagatgaagaagt

SEQ ID NO: 1824 - DNA, 22 bp, Chilo suppressalis
tgtaagaaatttatgcaagatc

SEQ ID NO: 1825 - DNA, 21 bp, Chilo suppressalis
aggtgtgcgacgtggacatca

SEQ ID NO: 1826 - DNA, 23 bp, Chilo suppressalis
gacttgaaggagcacatcaggaa

SEQ ID NO: 1827 - DNA, 23 bp, Chilo suppressalis
ggccagaacatccacaactgtga

SEQ ID NO: 1828 - DNA, 21 bp, Chilo suppressalis
tcttgcgagggagagaatcca

SEQ ID NO: 1829 - DNA, 29 bp, Chilo suppressalis
aaaactattgttttccacagaaaaaagaa

SEQ ID NO: 1830 - DNA, 23 bp, Chilo suppressalis
atcaaggacagaaaagtcaaagc

SEQ ID NO: 1831 - DNA, 23 bp, Chilo suppressalis
atctctgccaagtcaaactacaa

SEQ ID NO: 1832 - DNA, 23 bp, Chilo suppressalis
caatgtgccatcatcatgttcga

SEQ ID NO: 1833 - DNA, 26 bp, Chilo suppressalis
cccaactggcacagagatttagtgcg

SEQ ID NO: 1834 - DNA, 31 bp, Chilo suppressalis
gacacttgactggagagttcgagaaaagata

SEQ ID NO: 1835 - DNA, 23 bp, Chilo suppressalis
gatatcaaggacagaaaagtcaa

SEQ ID NO: 1836 - DNA, 23 bp, Chilo suppressalis
gccaagtcaaactacaatttcga

SEQ ID NO: 1837 - DNA, 24 bp, Chilo suppressalis
gctggccaagaaaagtttggtggt

SEQ ID NO: 1838 - DNA, 26 bp, Chilo suppressalis
ggccaagaaaagtttggtggtctccg

SEQ ID NO: 1839 - DNA, 23 bp, Chilo suppressalis
tacaaaaatgtacccaactggca

SEQ ID NO: 1840 - DNA, 29 bp, Chilo suppressalis
tacaaaaatgtacccaactggcacagaga

SEQ ID NO: 1841 - DNA, 23 bp, Chilo suppressalis
tatgggatactgctggccaagaa

SEQ ID NO: 1842 - DNA, 24 bp, Chilo suppressalis
tatgggatactgctggccaagaaa

SEQ ID NO: 1843 - DNA, 21 bp, Chilo suppressalis
tgggatactgctggccaagaa

SEQ ID NO: 1844 - DNA, 23 bp, Chilo suppressalis
tgtgccatcatcatgttcgatgt

SEQ ID NO: 1845 - DNA, 21 bp, Chilo suppressalis
ttgactggagagttcgagaaa

SEQ ID NO: 1846 - DNA, 22 bp, Chilo suppressalis
ttgactggagagttcgagaaaa

SEQ ID NO: 1847 - DNA, 21 bp, Chilo suppressalis
tgggatactgctggccaagaa

SEQ ID NO: 1848 - DNA, 23 bp, Chilo suppressalis
gatcccattcagtctgtcaaggg

SEQ ID NO: 1849 - DNA, 29 bp, Chilo suppressalis
ttccaagcaaagatgttggatatgttgaa

SEQ ID NO: 1850 - DNA, 29 bp, Chilo suppressalis
aaaaagatccaatcttcgaacatgctgaa

SEQ ID NO: 1851 - DNA, 23 bp, Chilo suppressalis
aaacaagtggaactccagaaaaa

SEQ ID NO: 1852 - DNA, 23 bp, Chilo suppressalis
aaagtgcgtgaggaccacgtacg

SEQ ID NO: 1853 - DNA, 23 bp, Chilo suppressalis
aagatcagcaacactctggagtc

SEQ ID NO: 1854 - DNA, 26 bp, Chilo suppressalis
aagatcagcaacactctggagtctcg

SEQ ID NO: 1855 - DNA, 21 bp, Chilo suppressalis
aagatccaatcttcgaacatg

SEQ ID NO: 1856 - DNA, 26 bp, Chilo suppressalis
aagatccaatcttcgaacatgctgaa

SEQ ID NO: 1857 - DNA, 35 bp, Chilo suppressalis
aagcagatcaagcatatgatggccttcatcgaaca

SEQ ID NO: 1858 - DNA, 41 bp, Chilo suppressalis
aagcagatcaagcatatgatggccttcatcgaacaagaggc

SEQ ID NO: 1859 - DNA, 23 bp, Chilo suppressalis
atgatggccttcatcgaacaaga

SEQ ID NO: 1860 - DNA, 26 bp, Chilo suppressalis
atgatggccttcatcgaacaagaggc

SEQ ID NO: 1861 - DNA, 29 bp, Chilo suppressalis
cagatcaagcatatgatggccttcatcga

SEQ ID NO: 1862 - DNA, 29 bp, Chilo suppressalis
cagcagcggctcaagatcatggaatacta

SEQ ID NO: 1863 - DNA, 29 bp, Chilo suppressalis
catatgatggccttcatcgaacaagaggc

SEQ ID NO: 1864 - DNA, 23 bp, Chilo suppressalis
ctcaaagtgcgtgaggaccacgt

SEQ ID NO: 1865 - DNA, 23 bp, Chilo suppressalis
ctcaagatcatggaatactacga

SEQ ID NO: 1866 - DNA, 32 bp, Chilo suppressalis
gaaatcgatgcaaaggccgaagaggagttcaa

SEQ ID NO: 1867 - DNA, 23 bp, Chilo suppressalis
gaactccagaaaaagatccaatc

SEQ ID NO: 1868 - DNA, 38 bp, Chilo suppressalis
gaactccagaaaaagatccaatcttcgaacatgctgaa

SEQ ID NO: 1869 - DNA, 23 bp, Chilo suppressalis
gaggaaatcgatgcaaaggccga

SEQ ID NO: 1870 - DNA, 29 bp, Chilo suppressalis
gccgaagaggagttcaacattgaaaaagg

SEQ ID NO: 1871 - DNA, 21 bp, Chilo suppressalis
gcgcctggctgaggtgcccaa

SEQ ID NO: 1872 - DNA, 23 bp, Chilo suppressalis
ggccgcctggtgcagcagcagcg

SEQ ID NO: 1873 - DNA, 22 bp, Chilo suppressalis
ggctcaagatcatggaatacta

SEQ ID NO: 1874 - DNA, 25 bp, Chilo suppressalis
ggctcaagatcatggaatactacga

SEQ ID NO: 1875 - DNA, 23 bp, Chilo suppressalis
tacgaaaagaaagagaaacaagt

SEQ ID NO: 1876 - DNA, 25 bp, Chilo suppressalis
tgaaggtgctcaaagtgcgtgagga

SEQ ID NO: 1877 - DNA, 46 bp, Chilo suppressalis
ttcaaaagcagatcaagcatatgatggccttcatcgaacaagaggc

SEQ ID NO: 1878 - DNA, 23 bp, Chilo suppressalis
aacgggccggagatcatgtccaa

SEQ ID NO: 1879 - DNA, 23 bp, Chilo suppressalis
aactgccccgatgagaagatccg

SEQ ID NO: 1880 - DNA, 23 bp, Chilo suppressalis
atcttcatcgatgaactggatgc

SEQ ID NO: 1881 - DNA, 23 bp, Chilo suppressalis
catatattgcccattgatgattc

SEQ ID NO: 1882 - DNA, 26 bp, Chilo suppressalis
ctcatgtatgggccgcctggtaccgg

SEQ ID NO: 1883 - DNA, 30 bp, Chilo suppressalis
ctgccccgatgagaagatccgcatgaaccg

SEQ ID NO: 1884 - DNA, 23 bp, Chilo suppressalis
gagaagatccgcatgaaccgcgt

SEQ ID NO: 1885 - DNA, 21 bp, Chilo suppressalis
gtacatatattgcccattgat

SEQ ID NO: 1886 - DNA, 23 bp, Chilo suppressalis
tcatcgcacgtgatcgtaatggc

SEQ ID NO: 1887 - DNA, 21 bp, Chilo suppressalis
ttcatggttcgcgggggcatg

SEQ ID NO: 1888 - DNA, 32 bp, Chilo suppressalis
aaatcggtgtacatgtaacctgggaaaccacg

SEQ ID NO: 1889 - DNA, 22 bp, Chilo suppressalis
aagttgtcctcgtggtcgtcca

SEQ ID NO: 1890 - DNA, 21 bp, Chilo suppressalis
acagatctgggcggcaatttc

SEQ ID NO: 1891 - DNA, 26 bp, Chilo suppressalis
acagccttcatggcctgcacgtcctt

SEQ ID NO: 1892 - DNA, 26 bp, Chilo suppressalis
acatcagagtggtccttgcgggtcat

SEQ ID NO: 1893 - DNA, 26 bp, Chilo suppressalis
accagcacgtgtttctcacactggta

SEQ ID NO: 1894 - DNA, 23 bp, Chilo suppressalis
acctcctcacgggcggcggacac

SEQ ID NO: 1895 - DNA, 29 bp, Chilo suppressalis
acgacagccttcatggcctgcacgtcctt

SEQ ID NO: 1896 - DNA, 26 bp, Chilo suppressalis
acgtagatctgtccctcagtgatgta

SEQ ID NO: 1897 - DNA, 26 bp, Chilo suppressalis
agagcctccgcgtacgaagacatgtc

SEQ ID NO: 1898 - DNA, 21 bp, Chilo suppressalis
agcaatggagttcatcacgtc

SEQ ID NO: 1899 - DNA, 23 bp, Chilo suppressalis
agcagctgccagccgatgtccag

SEQ ID NO: 1900 - DNA, 23 bp, Chilo suppressalis
agcatctccttggggaagatacg

SEQ ID NO: 1901 - DNA, 35 bp, Chilo suppressalis
agggcttcctcaccgacgacagccttcatggcctg

SEQ ID NO: 1902 - DNA, 26 bp, Chilo suppressalis
ataccagtctggatcatttcctcagg

SEQ ID NO: 1903 - DNA, 26 bp, Chilo suppressalis
atacgggaccaggggttgatgggctg

SEQ ID NO: 1904 - DNA, 26 bp, Chilo suppressalis
atagcggagataccagtctggatcat

SEQ ID NO: 1905 - DNA, 23 bp, Chilo suppressalis
atctgggcggcaatttcgttgtg

SEQ ID NO: 1906 - DNA, 21 bp, Chilo suppressalis
atggcagacttcatgagacga

SEQ ID NO: 1907 - DNA, 29 bp, Chilo suppressalis
atggtggccaaatcggtgtacatgtaacc

SEQ ID NO: 1908 - DNA, 30 bp, Chilo suppressalis
atggtggccaaatcggtgtacatgtaacct

SEQ ID NO: 1909 - DNA, 41 bp, Chilo suppressalis
atggtggccaaatcggtgtacatgtaacctgggaaaccacg

SEQ ID NO: 1910 - DNA, 60 bp, Chilo suppressalis
attcaagaacaggcacacgttctccatggagccgttctcctcgaagtcctgcttgaagaa

SEQ ID NO: 1911 - DNA, 29 bp, Chilo suppressalis
attgggggacctttgtcaatgggttttcc

SEQ ID NO: 1912 - DNA, 47 bp, Chilo suppressalis
cacacgttctccatggagccgttctcctcgaagtcctgcttgaagaa

SEQ ID NO: 1913 - DNA, 23 bp, Chilo suppressalis
cactggtaggccaagaactcagc

SEQ ID NO: 1914 - DNA, 21 bp, Chilo suppressalis
catctccttggggaagatacg

SEQ ID NO: 1915 - DNA, 23 bp, Chilo suppressalis
ccctcaccgatggcagacttcat

SEQ ID NO: 1916 - DNA, 23 bp, Chilo suppressalis
ccgatggcagacttcatgagacg

SEQ ID NO: 1917 - DNA, 40 bp, Chilo suppressalis
ccgtctccatgttcacacccatggcggcgaacacgatggc

SEQ ID NO: 1918 - DNA, 29 bp, Chilo suppressalis
ccgttctcctcgaagtcctgcttgaagaa

SEQ ID NO: 1919 - DNA, 31 bp, Chilo suppressalis
ccgttctcctcgaagtcctgcttgaagaacc

SEQ ID NO: 1920 - DNA, 50 bp, Chilo suppressalis
cgagcaatggagttcatcacgtcgatagcggagataccagtctggatcat

SEQ ID NO: 1921 - DNA, 44 bp, Chilo suppressalis
cgggccgtctccatgttcacacccatggcggcgaacacgatggc

SEQ ID NO: 1922 - DNA, 26 bp, Chilo suppressalis
cgtccgggcacctcctcacgggcggc

SEQ ID NO: 1923 - DNA, 32 bp, Chilo suppressalis
cgtccgggcacctcctcacgggcggcggacac

SEQ ID NO: 1924 - DNA, 23 bp, Chilo suppressalis
ctacagatctgggcggcaatttc

SEQ ID NO: 1925 - DNA, 29 bp, Chilo suppressalis
ctacagatctgggcggcaatttcgttgtg

SEQ ID NO: 1926 - DNA, 21 bp, Chilo suppressalis
ctcgtagatggtggccaaatc

SEQ ID NO: 1927 - DNA, 33 bp, Chilo suppressalis
ctcgtagatggtggccaaatcggtgtacatgta

SEQ ID NO: 1928 - DNA, 36 bp, Chilo suppressalis
ctcgtagatggtggccaaatcggtgtacatgtaacc

SEQ ID NO: 1929 - DNA, 48 bp, Chilo suppressalis
ctcgtagatggtggccaaatcggtgtacatgtaacctgggaaaccacg

SEQ ID NO: 1930 - DNA, 24 bp, Chilo suppressalis
gaacaggcacacgttctccatgga

SEQ ID NO: 1931 - DNA, 29 bp, Chilo suppressalis
gactcgaatactgtgcggttctcgtagtt

SEQ ID NO: 1932 - DNA, 35 bp, Chilo suppressalis
gacttcatgagacgagacagggaaggcagcacgtt

SEQ ID NO: 1933 - DNA, 23 bp, Chilo suppressalis
gagataccagtctggatcatttc

SEQ ID NO: 1934 - DNA, 26 bp, Chilo suppressalis
gagataccagtctggatcatttcctc

SEQ ID NO: 1935 - DNA, 23 bp, Chilo suppressalis
gatgaagttcttctcgaacttgg

SEQ ID NO: 1936 - DNA, 24 bp, Chilo suppressalis
gatgaagttcttctcgaacttggt

SEQ ID NO: 1937 - DNA, 44 bp, Chilo suppressalis
gatgaagttcttctcgaacttggtgaggaactcgaggtagagca

SEQ ID NO: 1938 - DNA, 21 bp, Chilo suppressalis
gatggggatctgcgtgatgga

SEQ ID NO: 1939 - DNA, 27 bp, Chilo suppressalis
gcacacgttctccatggagccgttctc

SEQ ID NO: 1940 - DNA, 44 bp, Chilo suppressalis
gccaaatcggtgtacatgtaacctgggaaaccacgtcgtccggg

SEQ ID NO: 1941 - DNA, 22 bp, Chilo suppressalis
gccaagaactcagcagcagtca

SEQ ID NO: 1942 - DNA, 22 bp, Chilo suppressalis
gccgtctccatgttcacaccca

SEQ ID NO: 1943 - DNA, 23 bp, Chilo suppressalis
gccgtctccatgttcacacccat

SEQ ID NO: 1944 - DNA, 29 bp, Chilo suppressalis
gcctgcacgtccttaccgatggcgtagca

SEQ ID NO: 1945 - DNA, 23 bp, Chilo suppressalis
gccttcatggcctgcacgtcctt

SEQ ID NO: 1946 - DNA, 38 bp, Chilo suppressalis
gccttcatggcctgcacgtccttaccgatggcgtagca

SEQ ID NO: 1947 - DNA, 23 bp, Chilo suppressalis
gcggcgaacacgatggcaaagtt

SEQ ID NO: 1948 - DNA, 32 bp, Chilo suppressalis
gcggcgaacacgatggcaaagttgtcctcgtg

SEQ ID NO: 1949 - DNA, 23 bp, Chilo suppressalis
gcgtacagctggttggaaacatc

SEQ ID NO: 1950 - DNA, 35 bp, Chilo suppressalis; identical to SEQ ID NO: 409

SEQ ID NO: 1951 - DNA, 37 bp, Chilo suppressalis; identical to SEQ ID NO: 410

SEQ ID NO: 1952 - DNA, 26 bp, Chilo suppressalis
ggatgggtgatgtcgtcgttgggcat

SEQ ID NO: 1953 - DNA, 32 bp, Chilo suppressalis
ggcagaccggcagccgagaaaatggggatctt

SEQ ID NO: 1954 - DNA, 23 bp, Chilo suppressalis
ggcatagtcaagatggggatctg

SEQ ID NO: 1955 - DNA, 27 bp, Chilo suppressalis
ggccgtctccatgttcacacccatggc

SEQ ID NO: 1956 - DNA, 23 bp, Chilo suppressalis
ggcgggtagatctgtctgttgtg

SEQ ID NO: 1957 - DNA, 56 bp, Chilo suppressalis
ggcgggtagatctgtctgttgtggagctgacggtctacgtagatctgtccctcagt

SEQ ID NO: 1958 - DNA, 23 bp, Chilo suppressalis
gggaagatacggagcagctgcca

SEQ ID NO: 1959 - DNA, 29 bp, Chilo suppressalis
gggttgatgggctgtccctggatgtccaa

SEQ ID NO: 1960 - DNA, 23 bp, Chilo suppressalis
ggttttccagagccgttgaatac

SEQ ID NO: 1961 - DNA, 26 bp, Chilo suppressalis
gtgatgaagttcttctcgaacttggt

SEQ ID NO: 1962 - DNA, 23 bp, Chilo suppressalis
gtgcggttctcgtagttgccctg

SEQ ID NO: 1963 - DNA, 26 bp, Chilo suppressalis
gtggccaaatcggtgtacatgtaacc

SEQ ID NO: 1964 - DNA, 26 bp, Chilo suppressalis
gtgtacatgtaacctgggaaaccacg

SEQ ID NO: 1965 - DNA, 29 bp, Chilo suppressalis
gtgtacatgtaacctgggaaaccacgtcg

SEQ ID NO: 1966 - DNA, 53 bp, Chilo suppressalis
gtgtacatgtaacctgggaaaccacgtcgtccgggcacctcctcacgggcggc

SEQ ID NO: 1967 - DNA, 23 bp, Chilo suppressalis
tcagagtggtccttgcgggtcat

SEQ ID NO: 1968 - DNA, 26 bp, Chilo suppressalis
tcagcaaggattgggggacctttgtc

SEQ ID NO: 1969 - DNA, 29 bp, Chilo suppressalis
tcctcaccgacgacagccttcatggcctg

SEQ ID NO: 1970 - DNA, 23 bp, Chilo suppressalis
tcctcagggtagatacgggacca

SEQ ID NO: 1971 - DNA, 38 bp, Chilo suppressalis
tcctcagggtagatacgggaccaggggttgatgggctg

SEQ ID NO: 1972 - DNA, 22 bp, Chilo suppressalis
tcgaagtcctgcttgaagaacc

SEQ ID NO: 1973 - DNA, 35 bp, Chilo suppressalis
tcgtagatggtggccaaatcggtgtacatgtaacc

SEQ ID NO: 1974 - DNA, 47 bp, Chilo suppressalis
tcgtagatggtggccaaatcggtgtacatgtaacctgggaaaccacg

SEQ ID NO: 1975 - DNA, 29 bp, Chilo suppressalis
tctacgtagatctgtccctcagtgatgta

SEQ ID NO: 1976 - DNA, 26 bp, Chilo suppressalis
tgcacgtccttaccgatggcgtagca

SEQ ID NO: 1977 - DNA, 23 bp, Chilo suppressalis
tgggtgatgtcgtcgttgggcat

SEQ ID NO: 1978 - DNA, 23 bp, Chilo suppressalis
tggtaggccaagaactcagcagc

SEQ ID NO: 1979 - DNA, 26 bp, Chilo suppressalis
ttcaagaacaggcacacgttctccat

SEQ ID NO: 1980 - DNA, 29 bp, Chilo suppressalis
ttcaagaacaggcacacgttctccatgga

SEQ ID NO: 1981 - DNA, 23 bp, Chilo suppressalis
ttctcacactggtaggccaagaa

SEQ ID NO: 1982 - DNA, 26 bp, Chilo suppressalis
ttctcctcgaagtcctgcttgaagaa

SEQ ID NO: 1983 - DNA, 26 bp, Chilo suppressalis
ttgagcatctccttggggaagatacg

SEQ ID NO: 1984 - DNA, 31 bp, Chilo suppressalis
ttgagcatctccttggggaagatacggagca

SEQ ID NO: 1985 - DNA, 38 bp, Chilo suppressalis
ttgagcatctccttggggaagatacggagcagctgcca

SEQ ID NO: 1986 - DNA, 47 bp, Chilo suppressalis
ttgagcatctccttggggaagatacggagcagctgccagccgatgtc

SEQ ID NO: 1987 - DNA, 21 bp, Chilo suppressalis
tccgactactcttccacggac

SEQ ID NO: 1988 - DNA, 21 bp, Chilo suppressalis
atacaagctgtgcaaggtgcg

SEQ ID NO: 1989 - DNA, 23 bp, Chilo suppressalis
aagcacattgacttctcgctgaa

SEQ ID NO: 1990 - DNA, 21 bp, Chilo suppressalis
cgcaacaagcgtgaggtgtgg

SEQ ID NO: 1991 - DNA, 24 bp, Chilo suppressalis
cgtctccagactcaggtgttcaag

SEQ ID NO: 1992 - DNA, 23 bp, Chilo suppressalis
tttaatgtatgggatactgctgg

SEQ ID NO: 1993 - DNA, 25 bp, Chilo suppressalis
cacttgactggagagttcgagaaaa

SEQ ID NO: 1994 - DNA, 25 bp, Chilo suppressalis
ctcgtgtcacctacaaaaatgtacc

SEQ ID NO: 1995 - DNA, 23 bp, Chilo suppressalis
cacttgactggagagttcgagaa

SEQ ID NO: 1996 - DNA, 22 bp, Chilo suppressalis
taggtgaatttgttgatgatta

SEQ ID NO: 1997 - DNA, 23 bp, Chilo suppressalis
aagaaagagaaacaagtggaact

SEQ ID NO: 1998 - DNA, 26 bp, Chilo suppressalis
gtgtacatgtaacctgggaaaccacg

SEQ ID NO: 1999 - DNA, 23 bp, Chilo suppressalis
gtgtacatgtaacctgggaaacc

SEQ ID NO: 2000 - DNA, 23 bp, Chilo suppressalis
gccaaatcggtgtacatgtaacc

SEQ ID NO: 2001 - DNA, 29 bp, Chilo suppressalis
aagttcttctcgaacttggtgaggaactc

SEQ ID NO: 2002 - DNA, 21 bp, Chilo suppressalis
tggtctccgcaacaagcgtga

SEQ ID NO: 2003 - DNA, 21 bp, Chilo suppressalis
ggtctccgcaacaagcgtgag

SEQ ID NO: 2004 - DNA, 24 bp, Chilo suppressalis
tggtctccgcaacaagcgtgaggt

SEQ ID NO: 2005 - DNA, 24 bp, Chilo suppressalis
tggtctccgcaacaagcgtgaggt

SEQ ID NO: 2006 - DNA, 23 bp, Chilo suppressalis
ggtctccgcaacaagcgtgaggt

SEQ ID NO: 2007 - DNA, 28 bp, Chilo suppressalis
tggtctccgcaacaagcgtgaggtgtgg

SEQ ID NO: 2008 - DNA, 21 bp, Chilo suppressalis
cgcaacaagcgtgaggtgtgg

SEQ ID NO: 2009 - DNA, 23 bp, Chilo suppressalis
tcccctctcgtatgacaattggt

SEQ ID NO: 2010 - DNA, 21 bp, Chilo suppressalis
atttagctttgacaaagaata

SEQ ID NO: 2011 - DNA, 23 bp, Chilo suppressalis
gagcacccttcagaagttcaaca

SEQ ID NO: 2012 - DNA, 21 bp, Chilo suppressalis
tgggatactgctggccaagaa

SEQ ID NO: 2013 - DNA, 29 bp, Chilo suppressalis
aagtttggtggtctccgagatggttacta

SEQ ID NO: 2014 - DNA, 23 bp, Chilo suppressalis
caatgtgccatcatcatgttcga

SEQ ID NO: 2015 - DNA, 21 bp, Chilo suppressalis
catcatcatgttcgatgtaac

SEQ ID NO: 2016 - DNA, 23 bp, Chilo suppressalis
cacttgactggagagttcgagaa

SEQ ID NO: 2017 - DNA, 23 bp, Chilo suppressalis
tgaaggttcttttttctgtggaa

SEQ ID NO: 2018 - DNA, 23 bp, Chilo suppressalis
ggatggtaccactcgcatcctgg

SEQ ID NO: 2019 - DNA, 21 bp, Chilo suppressalis
aacgagaggaagaagaagaag

SEQ ID NO: 2020 - DNA, 22 bp, Chilo suppressalis
agggcttcttcttcttcctctc

SEQ ID NO: 2021 - DNA, 21 bp, Chilo suppressalis
tagggcttcttcttcttcctc

SEQ ID NO: 2022 - DNA, 21 bp, Chilo suppressalis
gagatggtcgagttgcctcta

SEQ ID NO: 2023 - DNA, 21 bp, Chilo suppressalis
gctgaagactttttggacatc

SEQ ID NO: 2024 - DNA, 25 bp, Chilo suppressalis
cctcaccaagttcgagaagaacttc

SEQ ID NO: 2025 - DNA, 21 bp, Chilo suppressalis
gtcgtcggtgaggaagccctg

SEQ ID NO: 2026 - DNA, 27 bp, Chilo suppressalis
tcctcaccgacgacagccttcatggcc

SEQ ID NO: 2027 - DNA, 24 bp, Chilo suppressalis
gatgtttccaaccagctgtacgcc

SEQ ID NO: 2028 - DNA, 24 bp, Chilo suppressalis
ggcgtacagctggttggaaacatc

SEQ ID NO: 2029 - DNA, 25 bp, Chilo suppressalis
tgatgtttccaaccagctgtacgcc

SEQ ID NO: 2030 - DNA, 23 bp, Chilo suppressalis
atggcagacttcatgagacgaga

SEQ ID NO: 2031 - DNA, 23 bp, Chilo suppressalis
atgcccaacgacgacatcaccca

SEQ ID NO: 2032 - DNA, 23 bp, Chilo suppressalis
tgggtgatgtcgtcgttgggcat

SEQ ID NO: 2033 - DNA, 23 bp, Chilo suppressalis
actatgcccaacgacgacatcac

SEQ ID NO: 2034 - DNA, 21 bp, Chilo suppressalis
ggttacatgtacaccgatttg

SEQ ID NO: 2035 - DNA, 24 bp, Chilo suppressalis
cccaggttacatgtacaccgattt

SEQ ID NO: 2036 - DNA, 21 bp, Chilo suppressalis
acaccacgtttggccttgact

SEQ ID NO: 2037 - DNA, 23 bp, Chilo suppressalis
gccatgggtgtgaacatggagac

SEQ ID NO: 2038 - DNA, 34 bp, Chilo suppressalis
gacgaccacgaggacaactttgccatcgtgttcg

SEQ ID NO: 2039 - DNA, 23 bp, Chilo suppressalis
aagatccccattttctcggctgc

SEQ ID NO: 2040 - DNA, 697 bp, Chilo suppressalis
taaagcatggatgttggacaaactgggtggcgtgtacgcgccgcggccgtcgaccggcccccacaagttgcgcgagtgcctgccgctggtgatcttcctcaggaaccggctcaagtacgcgctcaccggaaatgaagtgcttaagattgtaaagcagcgacttatcaaagttgacggcaaagtcaggacagaccccacatatcccgctggatttatggatgttgtttccattgaaaagacaaatgagctgttccgtcttatatatgatgtcaaaggcagatttactattcaccgtattactcctgaggaggctaaatacaagctgtgcaaggtgcggcgcgtggcgacgggccccaagaacgtgccttacctggtgacccacgacggacgcaccgtgcgataccccgacccactcatcaaggtcaacgactccatccagctcgacatcgccacctccaagatcatggacttcatcaagtttgaatctggtaacctatgtatgatcacgggaggccgtaacttggggcgcgtgggcaccatcgtgtcccgcgagcgacatcccgggtccttcgacatcgtgcatatacgggactccaccggacataccttcgctaccagattgaacaacgtgttcataatcggcaagggcacgaaggcgtacatctcgctgccgcgcggcaagggcgtgcgactcacc

SEQ ID NO: 2041 - DNA, 27 bp, artificial sequence
  Description of artificial sequence:  synthetic primer
taaagcatggatgttggacaaactggg

SEQ ID NO: 2042 - DNA, 43 bp, artificial sequence
  Description of artificial sequence:  synthetic primer
gcgtaatacgactcactataggggtgagtcgcacgcccttgcc

SEQ ID NO: 2043 - DNA, 49 bp, artificial sequence
  Description of artificial sequence:  synthetic primer
gcgtaatacgactcactataggtaaagcatggatgttggacaaactggg

SEQ ID NO: 2044 - DNA, 21 bp, artificial sequence
  Description of artificial sequence:  synthetic primer
ggtgagtcgcacgcccttgcc

SEQ ID NO: 2045 - DNA, 343 bp, Chilo suppressalis
caagaaggaggagaagggtccatcaacacacgaagctatacagaaattacgcgaaacggaagagttattgcagaagaaacaagagtttctagagcgaaagatcgacactgaattacaaacggcgagaaaacatggcacaaagaataagagagctgccattgcggcactgaagcgcaagaagcgttatgaaaagcagcttacccagattgatggcacgcttacccaaattgaggcccaaagggaagcgctagaaggagctaacaccaatacacaggtgcttaacactatgcgagatgctgctaccgctatgagactcgcccacaaggatatcgatgtagacaag

SEQ ID NO: 2046 - DNA, 27 bp, artificial sequence
  Description of artificial sequence:  synthetic primer
caagaaggaggagaagggtccatcaac

SEQ ID NO: 2047 - DNA, 49 bp, artificial sequence
  Description of artificial sequence:  synthetic primer
gcgtaatacgactcactataggcttgtctacatcgatatccttgtgggc

SEQ ID NO: 2048 - DNA, 49 bp, artificial sequence
  Description of artificial sequence:  synthetic primer
gcgtaatacgactcactataggcaagaaggaggagaagggtccatcaac

SEQ ID NO: 2049 - DNA, 27 bp, artificial sequence
  Description of artificial sequence:  synthetic primer
cttgtctacatcgatatccttgtgggc

SEQ ID NO: 2050 - DNA, 392 bp, Chilo suppressalis
tggtctccgcaacaagcgtgaggtgtggagggtgaagtacacgctggccaggatccgtaaggctgcccgtgagctgctcacactcgaggagaaagaccctaagaggttattcgaaggtaatgctctccttcgtcgtctggtgaggatcggtgtgttggatgagaagcagatgaagctcgattatgtactcggtctgaagattgaggacttcttggaacgtcgtctccagactcaggtgttcaaggctggtctagctaagtctatccatcatgcccgtattcttatcagacagaggcacatccgtgtccgcaagcaagttgtgaacatcccttcgttcatcgtgcggctggactctggcaagcacattgacttctcgctgaagtctccgttcg

SEQ ID NO: 2051 - DNA, 23 bp, artificial sequence
  Description of artificial sequence:  synthetic primer
tggtctccgcaacaagcgtgagg

SEQ ID NO: 2052 - DNA, 48 bp, artificial sequence
  Description of artificial sequence:  synthetic primer
gcgtaatacgactcactataggcgaacggagacttcagcgagaagtca

SEQ ID NO: 2053 - DNA, 45 bp, artificial sequence
  Description of artificial sequence:  synthetic primer
gcgtaatacgactcactataggtggtctccgcaacaagcgtgagg

SEQ ID NO: 2054 - DNA, 26 bp, artificial sequence
  Description of artificial sequence:  synthetic primer
cgaacggagacttcagcgagaagtca

SEQ ID NO: 2055 - DNA, 467 bp, Chilo suppressalis
ggatgatgatggtataattgcaccagggattcgtgtatctggtgacgatgtagtcattggaaaaactataactttgccagaaaacgatgatgagctggaaggaacatcaagacgatacagtaagagagatgcctctacattcttgcgaaacagtgaaactggtattgttgaccaagttatgcttacacttaacagcgaaggatacaaattttgtaaaatacgtgtgagatctgtgagaatcccacaaattggagacaaatttgcttctcgtcatggtcaaaaagggacttgtggtattcaatataggcaagaagatatgcctttcacttgtgaaggattgacaccagatattatcatcaatccacatgctatcccctctcgtatgacaattggtcacttgattgaatgtattcaaggtaaggtctcctcaaataaaggtgaaataggtgatgctacaccatttaacg

SEQ ID NO: 2056 - DNA, 28 bp, artificial sequence
  Description of artificial sequence:  synthetic primer
ggatgatgatggtataattgcaccaggg

SEQ ID NO: 2057 - DNA, 53 bp, artificial sequence
  Description of artificial sequence:  synthetic primer
gcgtaatacgactcactataggcgttaaatggtgtagcatcacctatttcacc

SEQ ID NO: 2058 - DNA, 50 bp, artificial sequence
  Description of artificial sequence:  synthetic primer
gcgtaatacgactcactataggggatgatgatggtataattgcaccaggg

SEQ ID NO: 2059 - DNA, 31 bp, artificial sequence
  Description of artificial sequence:  synthetic primer
cgttaaatggtgtagcatcacctatttcacc

SEQ ID NO: 2060 - DNA, 947 bp, Chilo suppressalis
cttgttgaaaccagagattttgagggctatcgtcgattgcggtttcgagcacccttcagaagttcaacatgaatgtattccccaagctgttttgggaatggatattctttgtcaaagctaaatccggaatgggaaaaaccgccgtatttgttttagcaacactgcaacagctagaaccttcagaaaaccatgtttacgtattagtaatgtgccatacaagggaactcgctttccaaataagcaaggaatatgagaggttctctaaatatatggctggtgttagagtatctgtattctttggtgggatgccaattcagaaagatgaagaagtattgaagacagcctgcccgcacatcgttgttggtactcctggcagaatattagcattggttaacaacaagaaactgaatttaaaacacctgaaacacttcatcctggatgaatgtgacaaaatgcttgaatctctagacatgagacgtgatgtgcaggaaatattcaggaacacccctcacggtaagcaggtcatgatgttttctgcaacattgagtaaggagatcagaccagtctgtaagaaatttatgcaagatcctatggaagtttatgtggatgatgaagctaaacttacattgcacggtttgcagcaacattatgttaaactcaaggaaaatgaaaagaataagaagttatttgaacttttggatgtactggagttcaaccaagttgtcatatttgtaaagtcagtgcagcgctgcatagctctcgcacagctgctgacagaccaaaacttcccagctattggtatacaccgaaatatgactcaagatgagcgtctctcccgctatcagcagttcaaagatttccagaagaggatccttgttgcgacaaatctttttggacggggtatggacattgaaagagtcaacatagtcttcaattatgacatgccg

SEQ ID NO: 2061 - DNA, 27 bp, artificial sequence
  Description of artificial sequence:  synthetic primer
cttgttgaaaccagagattttgagggc

SEQ ID NO: 2062 - DNA, 54 bp, artificial sequence
  Description of artificial sequence:  synthetic primer
gcgtaatacgactcactataggcggcatgtcataattgaagactatgttgactc

SEQ ID NO: 2063 - DNA, 49 bp, artificial sequence
  Description of artificial sequence:  synthetic primer
gcgtaatacgactcactataggcttgttgaaaccagagattttgagggc

SEQ ID NO: 2064 - DNA, 32 bp, artificial sequence
  Description of artificial sequence:  synthetic primer
cggcatgtcataattgaagactatgttgactc

SEQ ID NO: 2065 - DNA, 481 bp, Chilo suppressalis
acgtttctgcagcggctggactcacgggagcccatgtggcagctggacgagagcatcatcggcaccaaccccgggctcggcttccggcccacgccgccagaggtcgccagcagcgtcatctggtataaaggcaacgaccccaacagccaacaattctgggtgcaagaaacctccaactttctaaccgcgtacaaacgagacggtaagaaagcaggagcaggccagaacatccacaactgtgatttcaaactgcctcctccggccggtaaggtgtgcgacgtggacatcagcgcctggagtccctgtgtagaggacaagcactttggataccacaagtccacgccctgcatcttcctcaaactcaacaagatcttcggctggaggccgcacttctacaacagctccgacagcctgcccactgacatgcccgacgacttgaaggagcacatcaggaatatgacagcgtacgataagaattatc

SEQ ID NO: 2066 - DNA, 23 bp, artificial sequence
  Description of artificial sequence:  synthetic primer
acgtttctgcagcggctggactc

SEQ ID NO: 2067 - DNA, 54 bp, artificial sequence
  Description of artificial sequence:  synthetic primer
gcgtaatacgactcactatagggataattcttatcgtacgctgtcatattcctg

SEQ ID NO: 2068 - DNA, 45 bp, artificial sequence
  Description of artificial sequence:  synthetic primer
gcgtaatacgactcactataggacgtttctgcagcggctggactc

SEQ ID NO: 2069 - DNA, 32 bp, artificial sequence
  Description of artificial sequence:  synthetic primer
gataattcttatcgtacgctgtcatattcctg

SEQ ID NO: 2070 - DNA, 441 bp, Chilo suppressalis
cgacacttgactggagagttcgagaaaagatatgtcgccacattaggtgtcgaggtgcatcccttagtattccacacaaatagaggccctataaggtttaatgtatgggatactgctggccaagaaaagtttggtggtctccgagatggttactatatccaaggtcaatgtgccatcatcatgttcgatgtaacgtctcgtgtcacctacaaaaatgtacccaactggcacagagatttagtgcgagtctgtgaaggcattccaattgttctttgtggcaacaaagtagatatcaaggacagaaaagtcaaagcaaaaactattgttttccacagaaaaaagaaccttcagtattatgacatctctgccaagtcaaactacaatttcgagaaacccttcctctggttagcgagaaagttgatcggtgatggtaacctagag

SEQ ID NO: 2071 - DNA, 25 bp, artificial sequence
  Description of artificial sequence:  synthetic primer
cgacacttgactggagagttcgaga

SEQ ID NO: 2072 - DNA, 48 bp, artificial sequence
  Description of artificial sequence:  synthetic primer
gcgtaatacgactcactataggctctaggttaccatcaccgatcaact

SEQ ID NO: 2073 - DNA, 47 bp, artificial sequence
  Description of artificial sequence:  synthetic primer
gcgtaatacgactcactataggcgacacttgactggagagttcgaga

SEQ ID NO: 2074 - DNA, 26 bp, artificial sequence
  Description of artificial sequence:  synthetic primer
ctctaggttaccatcaccgatcaact

SEQ ID NO: 2075 - DNA, 353 bp, Chilo suppressalis
tgccgaacaggtatacatctcgtctttggccctgttgaagatgttaaaacacgggcgcgccggtgttccaatggaagttatgggacttatgttaggtgaatttgttgatgattacacggtgcgtgtcatagacgtatttgccatgcctcaaactggcacaggagtgtcggttgaagctgtagatcctgtcttccaagcaaagatgttggatatgttgaagcaaactggacgacctgagatggtagtgggatggtaccactcgcatcctggctttggatgttggttatctggagtcgacattaatactcagcagtctttcgaagctttgtctgaacgtgctgtagctgtagtgg

SEQ ID NO: 2076 - DNA, 29 bp, artificial sequence
  Description of artificial sequence:  synthetic primer
tgccgaacaggtatacatctcgtctttgg

SEQ ID NO: 2077 - DNA, 48 bp, artificial sequence
  Description of artificial sequence:  synthetic primer
gcgtaatacgactcactataggccactacagctacagcacgttcagac

SEQ ID NO: 2078 - DNA, 51 bp, artificial sequence
  Description of artificial sequence:  synthetic primer
gcgtaatacgactcactataggtgccgaacaggtatacatctcgtctttgg

SEQ ID NO: 2079 - DNA, 26 bp, artificial sequence
  Description of artificial sequence:  synthetic primer
ccactacagctacagcacgttcagac

SEQ ID NO: 2080 - DNA, 617 bp, Chilo suppressalis
agatcaagcatatgatggccttcatcgaacaagaggctaatgaaaaggccgaggaaatcgatgcaaaggccgaagaggagttcaacattgaaaaaggccgcctggtgcagcagcagcggctcaagatcatggaatactacgaaaagaaagagaaacaagtggaactccagaaaaagatccaatcttcgaacatgctgaatcaagcccgtctgaaggtgctcaaagtgcgtgaggaccacgtacgcaacgttctcgacgaggctcgcaagcgcctggctgaggtgcccaaagacgtgaaactttacacagatctgctggtcacgctcgtcgtacaagccctattccagctcatggaacccacagtaacagttcgcgttaggcaggcggacgtctccttagtacagtccatattgggcaaggcacagcaggattacaaagcaaagatcaagaaggacgttcaattgaagatcgacaccgagaattccctgcccgccgatacttgtggcggagtggaacttattgctgctagagggcgtattaagatcagcaacactctggagtctcgtctggagctgatagcccaacaactgttgcccgaaatacgtaccgcattgttc

SEQ ID NO: 2081 - DNA, 29 bp, artificial sequence
  Description of artificial sequence:  synthetic primer
cagatcaagcatatgatggccttcatcga

SEQ ID NO: 2082 - DNA, 47 bp, artificial sequence
  Description of artificial sequence:  synthetic primer
gcgtaatacgactcactatagggaacaatgcggtacgtatttcgggc

SEQ ID NO: 2083 - DNA, 51 bp, artificial sequence
  Description of artificial sequence:  synthetic primer
gcgtaatacgactcactataggcagatcaagcatatgatggccttcatcga

SEQ ID NO: 2084 - DNA, 25 bp, artificial sequence
  Description of artificial sequence:  synthetic primer
gaacaatgcggtacgtatttcgggc

SEQ ID NO: 2085 - DNA, 826 bp, Chilo suppressalis
atcgtgctttcagacgataactgccccgatgagaagatccgcatgaaccgcgtcgtgcgaaacaacttgcgtgtacgcctgtcagacatagtctccatagcgccttgtccatcggtcaaatatgggaaacgggtacatatattgcccattgatgattctgtcgagggtttgactggaaatttattcgaagtctacttgaaaccatacttcatggaagcttatcggcctatccatcgcgatgacacattcatggttcgcgggggcatgagggctgttgaattcaaagtggtggagactgatccgtcgccgtattgcatcgtcgctcccgacacagtgatacactgcgaaggagaccctatcaaacgagaggaagaagaagaagccctaaacgccgtagggtacgacgacatcggtggctgtcgtaaacagctcgctcagatcaaagagatggtcgagttgcctctaaggcatccgtcgctgttcaaggcaattggtgtgaagccgccacgtggaatcctcatgtatgggccgcctggtaccggcaaaactctcattgctcgggcagtggctaatgaaactggtgcattcttctttctgatcaacgggccggagatcatgtccaaactcgcgggcgagtccgaatcgaaccttcgcaaggcattcgaggaagcggacaagaactccccggctataatcttcatcgatgaactggatgccatcgcaccaaagagggagaagactcacggtgaagtggagcgtcgtattgtgtcgcaactacttactcttatggatggaatgaagaagtcatcgcacgtgatcgtaatgg

SEQ ID NO: 2086 - DNA, 27 bp, artificial sequence
  Description of artificial sequence:  synthetic primer
atcgtgctttcagacgataactgcccc

SEQ ID NO: 2087 - DNA, 48 bp, artificial sequence
  Description of artificial sequence:  synthetic primer
gcgtaatacgactcactataggccattacgatcacgtgcgatgacttc

SEQ ID NO: 2088 - DNA, 49 bp, artificial sequence
  Description of artificial sequence:  synthetic primer
gcgtaatacgactcactataggatcgtgctttcagacgataactgcccc

SEQ ID NO: 2089 - DNA, 26 bp, artificial sequence
  Description of artificial sequence:  synthetic primer
ccattacgatcacgtgcgatgacttc

SEQ ID NO: 2090 - DNA, 1144 bp, Chilo suppressalis; identical to SEQ ID NO: 1702

SEQ ID NO: 2091 - DNA, 26 bp, artificial sequence
  Description of artificial sequence:  synthetic primer
aggatggaagcggggatacgtttgag

SEQ ID NO: 2092 - DNA, 47 bp, artificial sequence
  Description of artificial sequence:  synthetic primer
gcgtaatacgactcactatagggcacccctgtctccgaagacatgtt

SEQ ID NO: 2093 - DNA, 48 bp, artificial sequence
  Description of artificial sequence:  synthetic primer
gcgtaatacgactcactataggaggatggaagcggggatacgtttgag

SEQ ID NO: 2094 - DNA, 25 bp, artificial sequence
  Description of artificial sequence:  synthetic primer
gcacccctgtctccgaagacatgtt

SEQ ID NO: 2095 - DNA, 1153 bp, Chilo suppressalis
cgtccctgtacctgctcagcaatcccaacagcagcagagttaccgccacgtcagcgagagcgtcgaacacaaatcctacggcacgcaagggtacaccacttcggaacagaccaagcagacacagaaggtggcgtacaccaacggttccgactactcttccacggacgactttaaggtggatacgttcgaatacagactcctccgagaagtttcgttcagggaatccatcacgaagcggtacattggcgagacagacattcagatcagcacggaggtcgacaagtctctcggtgtggtgacccctcctaagatagcacaaaagcctaggaattccaagctgcaggagggagccgacgctcagtttcaagtgcagctgtcgggtaacccgcggccacgggtgtcatggttcaagaacgggcagaggatagtcaactcgaacaaacacgaaatcgtcacgacacataatcaaacaatacttagggtaagaaacacacaaaagtctgatactggcaactacacgttgttggctgaaaatcctaacggatgcgtcgtcacatcggcatacctggccgtggagtcgcctcaagaaacttacggccaagatcataaatcacaatacataatggacaatcagcaaacagctgtagaagaaagagtagaagttaatgaaaaagctctcgctccgcaattcgtaagagtctgccaagaccgcgatgtaacggaggggaaaatgacgcgattcgattgccgcgtcacgggcagaccttacccagaagtcacgtggttcattaacgatagacaaattcgagacgattatwatcataagatattagtaaacgaatcgtgtaatcatgcacttatgattacaaacgtcgatctcagtgatagtggcgtagtatcatgtatagcacgcaacaagaccggcgaaacttcgtttcagtgtaggctgaacgtgatagagaaggagcaagtggtcgctcccaaattcgtggagcggttcagcacgctcaacgtgcgcgagggcgagcccgtgcagctgcacgcgcgcgccgtcggcacgcctacgccacgcatcacatggcagaaggacggcgttcaagttatacccaatccagagctacgaataaataccgaaggtggggcctcgacgctg

SEQ ID NO: 2096 - DNA, 27 bp, artificial sequence
  Description of artificial sequence:  synthetic primer
cgtccctgtacctgctcagcaatccca

SEQ ID NO: 2097 - DNA, 42 bp, artificial sequence
  Description of artificial sequence:  synthetic primer
gcgtaatacgactcactataggcagcgtcgaggccccacctt

SEQ ID NO: 2098 - DNA, 49 bp, artificial sequence
  Description of artificial sequence:  synthetic primer
gcgtaatacgactcactataggcgtccctgtacctgctcagcaatccca

SEQ ID NO: 2099 - DNA, 20 bp, artificial sequence
  Description of artificial sequence:  synthetic primer
cagcgtcgaggccccacctt

SEQ ID NO: 2100 - DNA, 688 bp, ;Plutella xylostella
ggccccaagaagcatttgaagcgcctgaacgcgccgcgcgcatggatgctggacaagctcggcggcgtgtacgcgccgcggcccagcacgggcccgcacaagctgcgcgagtgcctgccgctcgtcatcttcctgcaaccgcctcaagtacgcgctcagcggcaacgaggtgctgaagatcgtgaagcagcgcctcatcaaggtggacggcaaggtccgcaccgaccccacctacccggctggattcatggatgttgtgtcgattgaaaagaccaatgagctgttccgtctgatctacgatgtgaagggacgcttcaccatccaccgcatcactcccgaggaggccaagtacaagctgtgcaaggtgaagcgcgtggcgacgggccccaagaacgtgccgtacatcgtgacgcacaacggccgcacgctgcgctaccccgacccgctcatcaaggtcaacgactccatccagctcgacatcgccacctgcaagatcatggacatcatcaagttcgactcaggtaacctgtgcatgatcacgggagggcgtaacttggggcgagtgggcaccatcgtgtcccgcgagaggcaccccgggagcttcgacatcgtccacatcaaggacaccaccggacacaccttcgccaccaggttgaacaacgtgttcatcatcggcaagggcacgaag

SEQ ID NO: 2101 - protein, 225 aa, Plutella xylostella
GPKKHLKRLNAPRAWMLDKLGGVYAPRPSTGPHKLRECLPLVIFLQPPQVRAQRQRGAEDREAAPHQGGRQGPHRPHLPGWIHGCCVDKDQAVPSDLRCEGTLHHPPHHSRGGQVQAVQGEARGDGPQERAVHRDAQRPHAALPRPAHQGQRLHPARHRHLQDHGHHQVRLRPVHDHGRALGASGHHRVPREAPRELRHRPHQGHHRTHLRHQVEQRVHHRQGHE

SEQ ID NO: 2102 - DNA, 580 bp, ;Plutella xylostella
gcacgttgatctggtacaaaggaaccggttacgacagctacaagtattgggagaaccagctcattgactttttgtcagtatacaagaagaagggtcagacagcgggtgctggtcagaacatcttcaactgtgacttccgcaacccgcccccacacggcaaggtgtgcgacgtggacatccgcggctgggagccctgcattgatgagaaccacttctctttccacaagtcttcgccttgcatcttcttgaagctgaataagatctacggctggcgtccagagttctacaacgacacggctaacctgcctgaagccatgcccgtggacttgcagacccacattcgtaacattactgccttcaacagagactatgcgaacatggtgtgggtgtcgtgccacggcgagacgccggcggacaaggagaacatcgggccggtgcgctacctgccctacccgggcttccccgggtacttctacccgtacgagaacgccgaggggtatctgagcccgctggtcgccgtgcatttggagaggccgaggaccggcatagtgatcaacatcgagtgcaaagcgtgggctgc

SEQ ID NO: 2103 - protein, 192 aa, Plutella xylostella
TLIWYKGTGYDSYKYWENQLIDFLSVYKKKGQTAGAGQNIFNCDFRNPPPHGKVCDVDIRGWEPCIDENHFSFHKSSPCIFLKLNKIYGWRPEFYNDTANLPEAMPVDLQTHIRNITAFNRDYANMVWVSCHGETPADKENIGPVRYLPYPGFPGYFYPYENAEGYLSPLVAVHLERPRTGIVINIECKAWA

SEQ ID NO: 2104 - DNA, 865 bp, ;Plutella xylostella
gtggctgcatacagttcattacgcagtaccagcactctagtggacaacgtcgcgttcgggtcaccactgtcgcgcgcaattggggcgacgcagccgccaacttacaccacatatcggcgggcttcgaccaggaggcggcggcggtggtgatggcgcggctggtggtgtaccgcgcggagcaggaggacgggcccgacgtgctgcgctggctcgaccgcatgctcatacgcctgtgccagaagttcggcgagtacgcgaaggacgacccgaacagcttccgtctgtcggagaacttcagcctgtacccgcagttcatgtaccacctgcgccgctcgcagttcctgcaggtcttcaacaactcgcccgacgagaccaccttctacagacacatgctgatgcgcgaagacctgacccaatccctcatcatgatccagccgatcctctactcgtacagcttcggaggcgcgcccgaacccgtgctgttagacaccagctccatccagcccgaccgcatcctgctcatggacaccttcttccagatcctcatctaccatggagagacaatggcgcaatggcgcgctctccgctaccaagacatggctgagtacgagaacttcaagcagctgctgcgagcgcccgtggacgacgcgcaggagatcctgcagaccaggttccccgtgccgcggtacattgatacagagcacggcggctcacaggcccggttcttgctttccaaagtgaatccctctcagactcacaacaacatgtacgcgtatggcggggcgatgccgataccatcagcggacggtggcgcccccgtgttgacggatgacgtgtcgctgcaagtgttcatggagcagccgcg

SEQ ID NO: 2105 - protein, 287 aa, Plutella xylostella
GCIQFITQYQHSSGQRRVRVTTVARNWGDAAANLHHISAGFDQEAAAVVMARLVVYRAEQEDGPDVLRWLDRMLIRLCQKFGEYAKDDPNSFRLSENFSLYPQFMYHLRRSQFLQVFNNSPDETTFYRHMLMREDLTQSLIMIQPILYSYSFGGAPEPVLLDTSSIQPDRILLMDTFFQILIYHGETMAQWRALRYQDMAEYENFKQLLRAPVDDAQEILQTRFPVPRYIDTEHGGSQARFLLSKVNPSQTHNNMYAYGGAMPIPSADGGAPVLTDDVSLQVFMEQP

SEQ ID NO: 2106 - DNA, 742 bp, ;Plutella xylostella
gccgcaaggagaccgtgtgcattgtgctgtccgacgacaactgccccgacgagaagatccgcatgaaccgcgtcgtccggaacaacctgcgagtgcgcctgtcagacattgtgtccatcgctccttgcccgtcagtgaagtacggcaagagagttcatattctgcccattgatgactctgttgagggtttgactggaaacctgttcgaagtctacctgaagccgtacttcatggaggcgtaccggcccatccaccgcgacgacacgttcatggtgcgcggcggcatgcgcgccgtcgagttcaaggtggtggagaccgacccctcgccctactgcatcgtggcccccgacacggtcattcattgtgagggagagccgattaaacgcgaggaagaagaggaggctctcaacgccgtcggctacgacgacatcggcgggtgccgcaagcagctggcgcagatcaaggagatggtggagctgccgctgcgccacccctcgctgttcaaggccatcggggtcaagccgccgcgggggatactgatgtacgggcccccggggacggggaagaccttgatcgctagggctgtcgctaatgagacgggcgcattcttcttcctcatcaacggccccgagatcatgtcgaaactcgccggtgaatccgagtcgaacctgcgcaaggcgttcgaggaggcggacaagaactctccggccatcatcctcattgatgaacttgatgccattgc

SEQ ID NO: 2107 - protein, 246 aa, Plutella xylostella
RKETVCIVLSDDNCPDEKIRMNRVVRNNLRVRLSDIVSIAPCPSVKYGKRVHILPIDDSVEGLTGNLFEVYLKPYFMEAYRPIHRDDTFMVRGGMRAVEFKVVETDPSPYCIVAPDTVIHCEGEPIKREEEEEALNAVGYDDIGGCRKQLAQIKEMVELPLRHPSLFKAIGVKPPRGILMYGPPGTGKTLIARAVANETGAFFFLINGPEIMSKLAGESESNLRKAFEEADKNSPAIILIDELDAI

SEQ ID NO: 2108 - DNA, 1138 bp, ;Plutella xylostella
gttcaccggcgatattctgcgcacgcccgtctctgaggacatgctgggtcgtattttcaacggctccggcaagcccatcgacaaggggcccccgatcctggccgaggagtacctggacatccaggggcagcccatcaacccgtggtcccgtatctacccggaggagatgatccagactggtatctccgctatcgacgtgatgaactccatcgcccgtggtcagaagatccccatcttctccgccgccggtctgccccacaacgagattgctgctcagatctgtaggcaggctggtcttgtcaaggtccccggaaaatccgtgttggacgaccacgaagacaacttcgccatcgtgttcgccgccatgggagtcaacatggagaccgccaggttcttcaagcaggacttcgaggagaacggttccatggagaacgtctgtctgttcttgaacttggccaatgacccgaccattgagaggattatcacgccgaggttggcgctgactgctgccgagttcttggcctaccagtgcgagaaacacgtgttggtaatcttgaccgacatgtcttcatacgcggaggctcttcgtgaagtgtcagccgcccgtgaggaggtgcccggacgacgtggtttcccaggttacatgtacacggatttggccacaatctacgagcgcgccgggcgagtcgagggccgcaacggctccatcacgcagatccccatcctgaccatgcccaacgacgacatcacccaccccatccccgacttgaccgggtacatcactgagggacagatctacgtggaccgtcagctgcacaacaggcagatctacccgccggtgaatgtgctcccgtcgctatctcgtctcatgaagtccgccatcggagagggcatgaccaggaaggaccactccgacgtgtccaaccaactgtacgcgtgctacgccatcggcaaggacgtgcaggcgatgaaggcggtggtgggcgaggaggcgctcacgcccgacgacctgctctacctcgagttcctcaccaagttcgagaagaacttcatcacacagggaagctacgagaaccgcacagtgttcgagtcgctggacatcggctggcagcccctgcgtatcttccccaaggagatg

SEQ ID NO: 2109 - protein, 379 aa, Plutella xylostella
FTGDILRTPVSEDMLGRIFNGSGKPIDKGPPILAEEYLDIQGQPINPWSRIYPEEMIQTGISAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFITQGSYENRTVFESLDIGWQPLRIFPKEM

SEQ ID NO: 2110 - DNA, 23 bp, artificial sequence
  Description of artificial sequence:  synthetic primer
ggccccaagaagcatttgaagcg

SEQ ID NO: 2111 - DNA, 28 bp, artificial sequence
  Description of artificial sequence:  synthetic primer
cttcgtgcccttgccratkatraabacg

SEQ ID NO: 2112 - DNA, 26 bp, artificial sequence
  Description of artificial sequence:  synthetic primer
gcacgttgatctggtacarrggmacc

SEQ ID NO: 2113 - DNA, 20 bp, artificial sequence
  Description of artificial sequence:  synthetic primer
gcagcccacgcyytgcactc

SEQ ID NO: 2114 - DNA, 26 bp, artificial sequence
  Description of artificial sequence:  synthetic primer
gtggctgcatacagttcattacgcag

SEQ ID NO: 2115 - DNA, 23 bp, artificial sequence
  Description of artificial sequence:  synthetic primer
cgcggctgctccatgaayasytg

SEQ ID NO: 2116 - DNA, 20 bp, artificial sequence
  Description of artificial sequence:  synthetic primer
gccgcaaggagacbgtvtgc

SEQ ID NO: 2117 - DNA, 24 bp, artificial sequence
  Description of artificial sequence:  synthetic primer
gcaatggcatcaakytcrtcratg

SEQ ID NO: 2118 - DNA, 21 bp, artificial sequence
  Description of artificial sequence:  synthetic primer
gttcaccggcgayatyctgcg

SEQ ID NO: 2119 - DNA, 25 bp, artificial sequence
  Description of artificial sequence:  synthetic primer
catctccttggggaagatacgcagc

SEQ ID NO: 2120 - DNA, 32 bp, Plutella xylostella
aacaacgtgttcatcatcggcaagggcacgaa

SEQ ID NO: 2121 - DNA, 21 bp, Plutella xylostella
aacgtgttcatcatcggcaag

SEQ ID NO: 2122 - DNA, 22 bp, Plutella xylostella
aacgtgttcatcatcggcaagg

SEQ ID NO: 2123 - DNA, 23 bp, Plutella xylostella
aacgtgttcatcatcggcaaggg

SEQ ID NO: 2124 - DNA, 29 bp, Plutella xylostella
aacgtgttcatcatcggcaagggcacgaa

SEQ ID NO: 2125 - DNA, 29 bp, Plutella xylostella
aacttggggcgagtgggcaccatcgtgtc

SEQ ID NO: 2126 - DNA, 36 bp, Plutella xylostella
aacttggggcgagtgggcaccatcgtgtcccgcgag

SEQ ID NO: 2127 - DNA, 41 bp, Plutella xylostella
aagatcgtgaagcagcgcctcatcaaggtggacggcaaggt

SEQ ID NO: 2128 - DNA, 23 bp, Plutella xylostella
aaggtccgcaccgaccccaccta

SEQ ID NO: 2129 - DNA, 21 bp, Plutella xylostella
aagtacaagctgtgcaaggtg

SEQ ID NO: 2130 - DNA, 31 bp, Plutella xylostella
acaacgtgttcatcatcggcaagggcacgaa

SEQ ID NO: 2131 - DNA, 22 bp, Plutella xylostella
acggcaaggtccgcaccgaccc

SEQ ID NO: 2132 - DNA, 50 bp, Plutella xylostella
acggccgcacgctgcgctaccccgacccgctcatcaaggtcaacgactcc

SEQ ID NO: 2133 - DNA, 25 bp, Plutella xylostella
acgtgttcatcatcggcaagggcac

SEQ ID NO: 2134 - DNA, 21 bp, Plutella xylostella
aggaggccaagtacaagctgt

SEQ ID NO: 2135 - DNA, 28 bp, Plutella xylostella
aggaggccaagtacaagctgtgcaaggt

SEQ ID NO: 2136 - DNA, 29 bp, Plutella xylostella
aggaggccaagtacaagctgtgcaaggtg

SEQ ID NO: 2137 - DNA, 21 bp, Plutella xylostella
caacgtgttcatcatcggcaa

SEQ ID NO: 2138 - DNA, 26 bp, Plutella xylostella
caacgtgttcatcatcggcaagggca

SEQ ID NO: 2139 - DNA, 32 bp, Plutella xylostella
cacaccttcgccaccaggttgaacaacgtgtt

SEQ ID NO: 2140 - DNA, 21 bp, Plutella xylostella
ccccaagaagcatttgaagcg

SEQ ID NO: 2141 - DNA, 22 bp, Plutella xylostella
ccgaggaggccaagtacaagct

SEQ ID NO: 2142 - DNA, 31 bp, Plutella xylostella
ccgaggaggccaagtacaagctgtgcaaggt

SEQ ID NO: 2143 - DNA, 29 bp, Plutella xylostella
ccgcacaagctgcgcgagtgcctgccgct

SEQ ID NO: 2144 - DNA, 22 bp, Plutella xylostella
cgacgggccccaagaacgtgcc

SEQ ID NO: 2145 - DNA, 21 bp, Plutella xylostella
cgaggaggccaagtacaagct

SEQ ID NO: 2146 - DNA, 22 bp, Plutella xylostella
cgaggaggccaagtacaagctg

SEQ ID NO: 2147 - DNA, 27 bp, Plutella xylostella
cgagtgggcaccatcgtgtcccgcgag

SEQ ID NO: 2148 - DNA, 36 bp, Plutella xylostella
cgctaccccgacccgctcatcaaggtcaacgactcc

SEQ ID NO: 2149 - DNA, 23 bp, Plutella xylostella
cgcttcaccatccaccgcatcac

SEQ ID NO: 2150 - DNA, 24 bp, Plutella xylostella
cggcaacgaggtgctgaagatcgt

SEQ ID NO: 2151 - DNA, 23 bp, Plutella xylostella
cgtaacttggggcgagtgggcac

SEQ ID NO: 2152 - DNA, 24 bp, Plutella xylostella
ctacccggctggattcatggatgt

SEQ ID NO: 2153 - DNA, 21 bp, Plutella xylostella
ctcatcaaggtcaacgactcc

SEQ ID NO: 2154 - DNA, 35 bp, Plutella xylostella; identical to SEQ ID NO: 1744

SEQ ID NO: 2155 - DNA, 21 bp, Plutella xylostella
gacggcaaggtccgcaccgac

SEQ ID NO: 2156 - DNA, 23 bp, Plutella xylostella
gacggcaaggtccgcaccgaccc

SEQ ID NO: 2157 - DNA, 29 bp, Plutella xylostella
gaggaggccaagtacaagctgtgcaaggt

SEQ ID NO: 2158 - DNA, 30 bp, Plutella xylostella
gaggaggccaagtacaagctgtgcaaggtg

SEQ ID NO: 2159 - DNA, 23 bp, Plutella xylostella
gaggccaagtacaagctgtgcaa

SEQ ID NO: 2160 - DNA, 27 bp, Plutella xylostella
gaggccaagtacaagctgtgcaaggtg

SEQ ID NO: 2161 - DNA, 23 bp, Plutella xylostella
gccaagtacaagctgtgcaaggt

SEQ ID NO: 2162 - DNA, 22 bp, Plutella xylostella
gccccaagaagcatttgaagcg

SEQ ID NO: 2163 - DNA, 21 bp, Plutella xylostella
gcgcgtggcgacgggccccaa

SEQ ID NO: 2164 - DNA, 22 bp, Plutella xylostella
gcgcgtggcgacgggccccaag

SEQ ID NO: 2165 - DNA, 27 bp, Plutella xylostella
ggaggccaagtacaagctgtgcaaggt

SEQ ID NO: 2166 - DNA, 23 bp, Plutella xylostella
ggccccaagaagcatttgaagcg

SEQ ID NO: 2167 - DNA, 24 bp, Plutella xylostella
ggcggcgtgtacgcgccgcggccc

SEQ ID NO: 2168 - DNA, 23 bp, Plutella xylostella
gtccgcaccgaccccacctaccc

SEQ ID NO: 2169 - DNA, 26 bp, Plutella xylostella
gtgggcaccatcgtgtcccgcgagag

SEQ ID NO: 2170 - DNA, 31 bp, Plutella xylostella
tcaaggtggacggcaaggtccgcaccgaccc

SEQ ID NO: 2171 - DNA, 22 bp, Plutella xylostella
tgatctacgatgtgaagggacg

SEQ ID NO: 2172 - DNA, 26 bp, Plutella xylostella
ttcatggatgttgtgtcgattgaaaa

SEQ ID NO: 2173 - DNA, 21 bp, Plutella xylostella
gctggattcatggatgttgtg

SEQ ID NO: 2174 - DNA, 42 bp, Plutella xylostella
aagcagcgcctcatcaaggtggacggcaaggtccgcaccgac

SEQ ID NO: 2175 - DNA, 21 bp, Plutella xylostella
aacatcttcaactgtgacttc

SEQ ID NO: 2176 - DNA, 22 bp, Plutella xylostella
tgatcaacatcgagtgcaaagc

SEQ ID NO: 2177 - DNA, 22 bp, Plutella xylostella
ttcttgaagctgaataagatct

SEQ ID NO: 2178 - DNA, 23 bp, Plutella xylostella
cagttcctgcaggtcttcaacaa

SEQ ID NO: 2179 - DNA, 27 bp, Plutella xylostella
ccatcagcggacggtggcgcccccgtg

SEQ ID NO: 2180 - DNA, 37 bp, Plutella xylostella
cccgcagttcatgtaccacctgcgccgctcgcagttc

SEQ ID NO: 2181 - DNA, 32 bp, Plutella xylostella
ccgaacagcttccgtctgtcggagaacttcag

SEQ ID NO: 2182 - DNA, 28 bp, Plutella xylostella
cgcctgtgccagaagttcggcgagtacg

SEQ ID NO: 2183 - DNA, 26 bp, Plutella xylostella
ctgcgccgctcgcagttcctgcaggt

SEQ ID NO: 2184 - DNA, 23 bp, Plutella xylostella
ctgtacccgcagttcatgtacca

SEQ ID NO: 2185 - DNA, 23 bp, Plutella xylostella
gacgtgctgcgctggctcgaccg

SEQ ID NO: 2186 - DNA, 29 bp, Plutella xylostella
gacgtgtcgctgcaagtgttcatggagca

SEQ ID NO: 2187 - DNA, 28 bp, Plutella xylostella
gagtacgagaacttcaagcagctgctgc

SEQ ID NO: 2188 - DNA, 23 bp, Plutella xylostella
ggcggggcgatgccgataccatc

SEQ ID NO: 2189 - DNA, 35 bp, Plutella xylostella
gtggctgcatacagttcattacgcagtaccagcac

SEQ ID NO: 2190 - DNA, 26 bp, Plutella xylostella
tcgcagttcctgcaggtcttcaacaa

SEQ ID NO: 2191 - DNA, 34 bp, Plutella xylostella
tgcgccgctcgcagttcctgcaggtcttcaacaa

SEQ ID NO: 2192 - DNA, 52 bp, Plutella xylostella
tgcgccgctcgcagttcctgcaggtcttcaacaactcgcccgacgagaccac

SEQ ID NO: 2193 - DNA, 65 bp, Plutella xylostella
ttcatgtaccacctgcgccgctcgcagttcctgcaggtcttcaacaactcgcccgacgagaccac

SEQ ID NO: 2194 - DNA, 26 bp, Plutella xylostella
atcctgctcatggacaccttcttcca

SEQ ID NO: 2195 - DNA, 32 bp, Plutella xylostella
caccgcgacgacacgttcatggtgcgcggcgg

SEQ ID NO: 2196 - DNA, 21 bp, Plutella xylostella
cagatcaaggagatggtggag

SEQ ID NO: 2197 - DNA, 23 bp, Plutella xylostella
cccgacgagaagatccgcatgaa

SEQ ID NO: 2198 - DNA, 29 bp, Plutella xylostella
cccgacgagaagatccgcatgaaccgcgt

SEQ ID NO: 2199 - DNA, 28 bp, Plutella xylostella
ccgacgagaagatccgcatgaaccgcgt

SEQ ID NO: 2200 - DNA, 26 bp, Plutella xylostella
cgcaaggagaccgtgtgcattgtgct

SEQ ID NO: 2201 - DNA, 23 bp, Plutella xylostella
gacgagaagatccgcatgaaccg

SEQ ID NO: 2202 - DNA, 26 bp, Plutella xylostella
gacgagaagatccgcatgaaccgcgt

SEQ ID NO: 2203 - DNA, 26 bp, Plutella xylostella
gcgcagatcaaggagatggtggagct

SEQ ID NO: 2204 - DNA, 21 bp, Plutella xylostella
ggcatgcgcgccgtcgagttc

SEQ ID NO: 2205 - DNA, 21 bp, Plutella xylostella
gtgcgcggcggcatgcgcgcc

SEQ ID NO: 2206 - DNA, 21 bp, Plutella xylostella
tcaaggagatggtggagctgc

SEQ ID NO: 2207 - DNA, 22 bp, Plutella xylostella
tgaagccgtacttcatggaggc

SEQ ID NO: 2208 - DNA, 35 bp, Plutella xylostella
tgccgcaagcagctggcgcagatcaaggagatggt

SEQ ID NO: 2209 - DNA, 23 bp, Plutella xylostella
tggaggcgtaccggcccatccac

SEQ ID NO: 2210 - DNA, 23 bp, Plutella xylostella
aaggaccactccgacgtgtccaa

SEQ ID NO: 2211 - DNA, 23 bp, Plutella xylostella
aaggacgtgcaggcgatgaaggc

SEQ ID NO: 2212 - DNA, 24 bp, Plutella xylostella
accaagttcgagaagaacttcatc

SEQ ID NO: 2213 - DNA, 26 bp, Plutella xylostella
accaagttcgagaagaacttcatcac

SEQ ID NO: 2214 - DNA, 29 bp, Plutella xylostella
accgccaggttcttcaagcaggacttcga

SEQ ID NO: 2215 - DNA, 29 bp, Plutella xylostella
accggcgatattctgcgcacgcccgtctc

SEQ ID NO: 2216 - DNA, 22 bp, Plutella xylostella
agcaggacttcgaggagaacgg

SEQ ID NO: 2217 - DNA, 29 bp, Plutella xylostella
atcacgcagatccccatcctgaccatgcc

SEQ ID NO: 2218 - DNA, 26 bp, Plutella xylostella
atcttgaccgacatgtcttcatacgc

SEQ ID NO: 2219 - DNA, 26 bp, Plutella xylostella
atgaccaggaaggaccactccgacgt

SEQ ID NO: 2220 - DNA, 23 bp, Plutella xylostella
atgcccaacgacgacatcaccca

SEQ ID NO: 2221 - DNA, 44 bp, Plutella xylostella
cagaagatccccatcttctccgccgccggtctgccccacaacga

SEQ ID NO: 2222 - DNA, 35 bp, Plutella xylostella
caggacttcgaggagaacggttccatggagaacgt

SEQ ID NO: 2223 - DNA, 23 bp, Plutella xylostella
ccaagttcgagaagaacttcatc

SEQ ID NO: 2224 - DNA, 35 bp, Plutella xylostella
cccatcaacccgtggtcccgtatctacccggagga

SEQ ID NO: 2225 - DNA, 41 bp, Plutella xylostella
cccgacttgaccgggtacatcactgagggacagatctacgt

SEQ ID NO: 2226 - DNA, 35 bp, Plutella xylostella
cccggacgacgtggtttcccaggttacatgtacac

SEQ ID NO: 2227 - DNA, 30 bp, Plutella xylostella
cctggacatccaggggcagcccatcaaccc

SEQ ID NO: 2228 - DNA, 38 bp, Plutella xylostella
cgacgtggtttcccaggttacatgtacacggatttggc

SEQ ID NO: 2229 - DNA, 23 bp, Plutella xylostella
cgtctcatgaagtccgccatcgg

SEQ ID NO: 2230 - DNA, 36 bp, Plutella xylostella
cgtctcatgaagtccgccatcggagagggcatgacc

SEQ ID NO: 2231 - DNA, 26 bp, Plutella xylostella
cgtggtcagaagatccccatcttctc

SEQ ID NO: 2232 - DNA, 29 bp, Plutella xylostella
cgtggtcagaagatccccatcttctccgc

SEQ ID NO: 2233 - DNA, 26 bp, Plutella xylostella
cgtggtttcccaggttacatgtacac

SEQ ID NO: 2234 - DNA, 59 bp, Plutella xylostella
cgtggtttcccaggttacatgtacacggatttggccacaatctacgagcgcgccgggcg

SEQ ID NO: 2235 - DNA, 27 bp, Plutella xylostella
ctacgagaaccgcacagtgttcgagtc

SEQ ID NO: 2236 - DNA, 23 bp, Plutella xylostella
ctgcgtatcttccccaaggagat

SEQ ID NO: 2237 - DNA, 23 bp, Plutella xylostella
ctgtacgcgtgctacgccatcgg

SEQ ID NO: 2238 - DNA, 23 bp, Plutella xylostella
ctgttcttgaacttggccaatga

SEQ ID NO: 2239 - DNA, 26 bp, Plutella xylostella
ctgttcttgaacttggccaatgaccc

SEQ ID NO: 2240 - DNA, 23 bp, Plutella xylostella
gacaacttcgccatcgtgttcgc

SEQ ID NO: 2241 - DNA, 26 bp, Plutella xylostella
gacaacttcgccatcgtgttcgccgc

SEQ ID NO: 2242 - DNA, 32 bp, Plutella xylostella
gacaacttcgccatcgtgttcgccgccatggg

SEQ ID NO: 2243 - DNA, 23 bp, Plutella xylostella
gaccgtcagctgcacaacaggca

SEQ ID NO: 2244 - DNA, 21 bp, Plutella xylostella
gacctgctctacctcgagttc

SEQ ID NO: 2245 - DNA, 23 bp, Plutella xylostella
gacgtgatgaactccatcgcccg

SEQ ID NO: 2246 - DNA, 26 bp, Plutella xylostella
gacgtgatgaactccatcgcccgtgg

SEQ ID NO: 2247 - DNA, 23 bp, Plutella xylostella
gagaacggttccatggagaacgt

SEQ ID NO: 2248 - DNA, 32 bp, Plutella xylostella
gaggagatgatccagactggtatctccgctat

SEQ ID NO: 2249 - DNA, 50 bp, Plutella xylostella
gaggagatgatccagactggtatctccgctatcgacgtgatgaactccat

SEQ ID NO: 2250 - DNA, 24 bp, Plutella xylostella
gaggaggcgctcacgcccgacgac

SEQ ID NO: 2251 - DNA, 26 bp, Plutella xylostella
gagttcttggcctaccagtgcgagaa

SEQ ID NO: 2252 - DNA, 35 bp, Plutella xylostella
gccaggttcttcaagcaggacttcgaggagaacgg

SEQ ID NO: 2253 - DNA, 23 bp, Plutella xylostella
gcccgtggtcagaagatccccat

SEQ ID NO: 2254 - DNA, 29 bp, Plutella xylostella
gcccgtggtcagaagatccccatcttctc

SEQ ID NO: 2255 - DNA, 35 bp, Plutella xylostella
gcccgtggtcagaagatccccatcttctccgccgc

SEQ ID NO: 2256 - DNA, 29 bp, Plutella xylostella
gccgagttcttggcctaccagtgcgagaa

SEQ ID NO: 2257 - DNA, 41 bp, Plutella xylostella
gccgagttcttggcctaccagtgcgagaaacacgtgttggt

SEQ ID NO: 2258 - DNA, 26 bp, Plutella xylostella
gccgcccgtgaggaggtgcccggacg

SEQ ID NO: 2259 - DNA, 47 bp, Plutella xylostella
gcctaccagtgcgagaaacacgtgttggtaatcttgaccgacatgtc

SEQ ID NO: 2260 - DNA, 22 bp, Plutella xylostella
ggcagatctacccgccggtgaa

SEQ ID NO: 2261 - DNA, 26 bp, Plutella xylostella
ggcgaggaggcgctcacgcccgacga

SEQ ID NO: 2262 - DNA, 23 bp, Plutella xylostella
ggtcagaagatccccatcttctc

SEQ ID NO: 2263 - DNA, 26 bp, Plutella xylostella
ggttacatgtacacggatttggccac

SEQ ID NO: 2264 - DNA, 26 bp, Plutella xylostella
gtggtgggcgaggaggcgctcacgcc

SEQ ID NO: 2265 - DNA, 21 bp, Plutella xylostella
gttcaccggcgatattctgcg

SEQ ID NO: 2266 - DNA, 24 bp, Plutella xylostella
gttcaccggcgatattctgcgcac

SEQ ID NO: 2267 - DNA, 26 bp, Plutella xylostella
taccagtgcgagaaacacgtgttggt

SEQ ID NO: 2268 - DNA, 35 bp, Plutella xylostella
tacgccatcggcaaggacgtgcaggcgatgaaggc

SEQ ID NO: 2269 - DNA, 23 bp, Plutella xylostella
tccatcacgcagatccccatcct

SEQ ID NO: 2270 - DNA, 23 bp, Plutella xylostella
tccggcaagcccatcgacaaggg

SEQ ID NO: 2271 - DNA, 23 bp, Plutella xylostella
tctacgagcgcgccgggcgagtc

SEQ ID NO: 2272 - DNA, 26 bp, Plutella xylostella
tctcgtctcatgaagtccgccatcgg

SEQ ID NO: 2273 - DNA, 49 bp, Plutella xylostella
tgactgctgccgagttcttggcctaccagtgcgagaaacacgtgttggt

SEQ ID NO: 2274 - DNA, 22 bp, Plutella xylostella
tgcacaacaggcagatctaccc

SEQ ID NO: 2275 - DNA, 22 bp, Plutella xylostella
tgcgtatcttccccaaggagat

SEQ ID NO: 2276 - DNA, 29 bp, Plutella xylostella
tgctacgccatcggcaaggacgtgcaggc

SEQ ID NO: 2277 - DNA, 44 bp, Plutella xylostella
tgctctacctcgagttcctcaccaagttcgagaagaacttcatc

SEQ ID NO: 2278 - DNA, 23 bp, Plutella xylostella
tgtctgttcttgaacttggccaa

SEQ ID NO: 2279 - DNA, 26 bp, Plutella xylostella
tgtctgttcttgaacttggccaatga

SEQ ID NO: 2280 - DNA, 22 bp, Plutella xylostella
tgttcttgaacttggccaatga

SEQ ID NO: 2281 - DNA, 23 bp, Plutella xylostella
ttcaacggctccggcaagcccat

SEQ ID NO: 2282 - DNA, 32 bp, Plutella xylostella
ttcaacggctccggcaagcccatcgacaaggg

SEQ ID NO: 2283 - DNA, 26 bp, Plutella xylostella
ttcgaggagaacggttccatggagaa

SEQ ID NO: 2284 - DNA, 29 bp, Plutella xylostella
ttcgaggagaacggttccatggagaacgt

SEQ ID NO: 2285 - DNA, 26 bp, Plutella xylostella
ttcttcaagcaggacttcgaggagaa

SEQ ID NO: 2286 - DNA, 29 bp, Plutella xylostella
ttcttcaagcaggacttcgaggagaacgg

SEQ ID NO: 2287 - DNA, 32 bp, Plutella xylostella
ttcttcaagcaggacttcgaggagaacggttc

SEQ ID NO: 2288 - DNA, 44 bp, Plutella xylostella
ttcttcaagcaggacttcgaggagaacggttccatggagaacgt

SEQ ID NO: 2289 - DNA, 23 bp, Plutella xylostella
ttcttgaacttggccaatgaccc

SEQ ID NO: 2290 - DNA, 23 bp, Plutella xylostella
ttcttggcctaccagtgcgagaa

SEQ ID NO: 2291 - DNA, 21 bp, Plutella xylostella
ctcgacatcgccacctgcaag

SEQ ID NO: 2292 - DNA, 21 bp, Plutella xylostella
gacggcaaggtccgcaccgac

SEQ ID NO: 2293 - DNA, 21 bp, Plutella xylostella
cccggctggattcatggatgt

SEQ ID NO: 2294 - DNA, 26 bp, Plutella xylostella
atcaaggtggacggcaaggtccgcac

SEQ ID NO: 2295 - DNA, 22 bp, Plutella xylostella
acaacgtgttcatcatcggcaa

SEQ ID NO: 2296 - DNA, 35 bp, Plutella xylostella
cgtggtttcccaggttacatgtacacggatttggc

SEQ ID NO: 2297 - DNA, 23 bp, Plutella xylostella
ggtttcccaggttacatgtacac

SEQ ID NO: 2298 - DNA, 29 bp, Plutella xylostella
gagttcctcaccaagttcgagaagaactt

SEQ ID NO: 2299 - DNA, 23 bp, Plutella xylostella
ctcatcaaggtggacggcaaggt

SEQ ID NO: 2300 - DNA, 28 bp, Plutella xylostella
tcggtgcggaccttgccgtccaccttga

SEQ ID NO: 2301 - DNA, 21 bp, Plutella xylostella
gacggcaaggtccgcaccgac

SEQ ID NO: 2302 - DNA, 23 bp, Plutella xylostella
gacggcaaggtccgcaccgaccc

SEQ ID NO: 2303 - DNA, 26 bp, Plutella xylostella
aaggtccgcaccgaccccacctaccc

SEQ ID NO: 2304 - DNA, 23 bp, Plutella xylostella
cgcttcaccatccaccgcatcac

SEQ ID NO: 2305 - DNA, 22 bp, Plutella xylostella
cgaggaggccaagtacaagctg

SEQ ID NO: 2306 - DNA, 26 bp, Plutella xylostella
gaggccaagtacaagctgtgcaaggt

SEQ ID NO: 2307 - DNA, 21 bp, Plutella xylostella
gccaagtacaagctgtgcaag

SEQ ID NO: 2308 - DNA, 27 bp, Plutella xylostella
cccgacccgctcatcaaggtcaacgac

SEQ ID NO: 2309 - DNA, 22 bp, Plutella xylostella
cgacatcgtccacatcaaggac

SEQ ID NO: 2310 - DNA, 30 bp, Plutella xylostella
ccgcacaagctgcgcgagtgcctgccgctc

SEQ ID NO: 2311 - DNA, 23 bp, Plutella xylostella
ttcgaccaggaggcggcggcggt

SEQ ID NO: 2312 - DNA, 21 bp, Plutella xylostella
caccaccgccgccgcctcctg

SEQ ID NO: 2313 - DNA, 28 bp, Plutella xylostella
tgcaggtcttcaacaactcgcccgacga

SEQ ID NO: 2314 - DNA, 23 bp, Plutella xylostella
ttcaacaactcgcccgacgagac

SEQ ID NO: 2315 - DNA, 27 bp, Plutella xylostella
catgcgcgccgtcgagttcaaggtggt

SEQ ID NO: 2316 - DNA, 23 bp, Plutella xylostella
gcattcttcttcctcatcaacgg

SEQ ID NO: 2317 - DNA, 23 bp, Plutella xylostella
atcaacggccccgagatcatgtc

SEQ ID NO: 2318 - DNA, 22 bp, Plutella xylostella
tgcgcaaggcgttcgaggaggc

SEQ ID NO: 2319 - DNA, 25 bp, Plutella xylostella
cctcaccaagttcgagaagaacttc

SEQ ID NO: 2320 - DNA, 23 bp, Plutella xylostella
gaggagatgatccagactggtat

SEQ ID NO: 2321 - DNA, 26 bp, Plutella xylostella
gaggagatgatccagactggtatctc

SEQ ID NO: 2322 - DNA, 32 bp, Plutella xylostella
atgaactccatcgcccgtggtcagaagatccc

SEQ ID NO: 2323 - DNA, 26 bp, Plutella xylostella
gtcagaagatccccatcttctccgcc

SEQ ID NO: 2324 - DNA, 23 bp, Plutella xylostella
cagaagatccccatcttctccgc

SEQ ID NO: 2325 - DNA, 24 bp, Plutella xylostella
cagaagatccccatcttctccgcc

SEQ ID NO: 2326 - DNA, 29 bp, Plutella xylostella
cagaagatccccatcttctccgccgccgg

SEQ ID NO: 2327 - DNA, 29 bp, Plutella xylostella
aagatccccatcttctccgccgccggtct

SEQ ID NO: 2328 - DNA, 26 bp, Plutella xylostella
cccatcttctccgccgccggtctgcc

SEQ ID NO: 2329 - DNA, 26 bp, Plutella xylostella
ggtctgccccacaacgagattgctgc

SEQ ID NO: 2330 - DNA, 29 bp, Plutella xylostella
ttcgccgccatgggagtcaacatggagac

SEQ ID NO: 2331 - DNA, 23 bp, Plutella xylostella
accgccaggttcttcaagcagga

SEQ ID NO: 2332 - DNA, 23 bp, Plutella xylostella
ctgttcttgaacttggccaatga

SEQ ID NO: 2333 - DNA, 21 bp, Plutella xylostella
ggttacatgtacacggatttg

SEQ ID NO: 2334 - DNA, 24 bp, Plutella xylostella
ggcaagcccatcgacaaggggccc

SEQ ID NO: 2335 - DNA, 34 bp, Plutella xylostella
atggggtgggtgatgtcgtcgttgggcatggtca

SEQ ID NO: 2336 - DNA, 29 bp, Plutella xylostella
accatgcccaacgacgacatcacccaccc

SEQ ID NO: 2337 - DNA, 22 bp, Plutella xylostella
tgcacaacaggcagatctaccc

SEQ ID NO: 2338 - DNA, 23 bp, Plutella xylostella
ccgtcgctatctcgtctcatgaa

SEQ ID NO: 2339 - DNA, 514 bp, Plutella xylostella
cgaggtgctgaagatcgtgaagcagcgcctcatcaaggtggacggcaaggtccgcaccgaccccacctacccggctggattcatggatgttgtgtcgattgaaaagaccaatgagctgttccgtctgatctacgatgtgaagggacgcttcaccatccaccgcatcactcccgaggaggccaagtacaagctgtgcaaggtgaagcgcgtggcgacgggccccaagaacgtgccgtacatcgtgacgcacaacggccgcacgctgcgctaccccgacccgctcatcaaggtcaacgactccatccagctcgacatcgccacctgcaagatcatggacatcatcaagttcgactcaggtaacctgtgcatgatcacgggagggcgtaacttggggcgagtgggcaccatcgtgtcccgcgagaggcaccccgggagcttcgacatcgtccacatcaaggacaccaccggacacaccttcgccaccaggttgaacaacgtgttcatcatcggcaag

SEQ ID NO: 2340 - DNA, 44 bp, artificial sequence
  Description of artificial sequence:  synthetic primer
gcgtaatacgactcactataggcgaggtgctgaagatcgtgaag

SEQ ID NO: 2341 - DNA, 22 bp, artificial sequence
  Description of artificial sequence:  synthetic primer
cttgccgatgatgaacacgttg

SEQ ID NO: 2342 - DNA, 22 bp, artificial sequence
  Description of artificial sequence:  synthetic primer
cgaggtgctgaagatcgtgaag

SEQ ID NO: 2343 - DNA, 44 bp, artificial sequence
  Description of artificial sequence:  synthetic primer
gcgtaatacgactcactataggcttgccgatgatgaacacgttg

SEQ ID NO: 2344 - DNA, 524 bp, Plutella xylostella
cagctacaagtattgggagaaccagctcattgactttttgtcagtatacaagaagaagggtcagacagcgggtgctggtcagaacatcttcaactgtgacttccgcaacccgcccccacacggcaaggtgtgcgacgtggacatccgcggctgggagccctgcattgatgagaaccacttctctttccacaagtcttcgccttgcatcttcttgaagctgaataagatctacggctggcgtccagagttctacaacgacacggctaacctgcctgaagccatgcccgtggacttgcagacccacattcgtaacattactgccttcaacagagactatgcgaacatggtgtgggtgtcgtgccacggcgagacgccggcggacaaggagaacatcgggccggtgcgctacctgccctacccgggcttccccgggtacttctacccgtacgagaacgccgaggggtatctgagcccgctggtcgccgtgcatttggagaggccgaggaccggcatagtgatcaaca

SEQ ID NO: 2345 - DNA, 47 bp, artificial sequence
  Description of artificial sequence:  synthetic primer
gcgtaatacgactcactataggcagctacaagtattgggagaaccag

SEQ ID NO: 2346 - DNA, 22 bp, artificial sequence
  Description of artificial sequence:  synthetic primer
tgttgatcactatgccggtcct

SEQ ID NO: 2347 - DNA, 25 bp, artificial sequence
  Description of artificial sequence:  synthetic primer
cagctacaagtattgggagaaccag

SEQ ID NO: 2348 - DNA, 44 bp, artificial sequence
  Description of artificial sequence:  synthetic primer
gcgtaatacgactcactataggtgttgatcactatgccggtcct

SEQ ID NO: 2349 - DNA, 672 bp, Plutella xylostella
accagcactctagtggacaacgtcgcgttcgggtcaccactgtcgcgcgcaattggggcgacgcagccgccaacttacaccacatatcggcgggcttcgaccaggaggcggcggcggtggtgatggcgcggctggtggtgtaccgcgcggagcaggaggacgggcccgacgtgctgcgctggctcgaccgcatgctcatacgcctgtgccagaagttcggcgagtacgcgaaggacgacccgaacagcttccgtctgtcggagaacttcagcctgtacccgcagttcatgtaccacctgcgccgctcgcagttcctgcaggtcttcaacaactcgcccgacgagaccaccttctacagacacatgctgatgcgcgaagacctgacccaatccctcatcatgatccagccgatcctctactcgtacagcttcggaggcgcgcccgaacccgtgctgttagacaccagctccatccagcccgaccgcatcctgctcatggacaccttcttccagatcctcatctaccatggagagacaatggcgcaatggcgcgctctccgctaccaagacatggctgagtacgagaacttcaagcagctgctgcgagcgcccgtggacgacgcgcaggagatcctgcagaccaggttccccgtgccgcggtacattgatacag

SEQ ID NO: 2350 - DNA, 46 bp, artificial sequence
  Description of artificial sequence:  synthetic primer
gcgtaatacgactcactataggaccagcactctagtggacaacgtc

SEQ ID NO: 2351 - DNA, 22 bp, artificial sequence
  Description of artificial sequence:  synthetic primer
ctgtatcaatgtaccgcggcac

SEQ ID NO: 2352 - DNA, 24 bp, artificial sequence
  Description of artificial sequence:  synthetic primer
accagcactctagtggacaacgtc

SEQ ID NO: 2353 - DNA, 44 bp, artificial sequence
  Description of artificial sequence:  synthetic primer
gcgtaatacgactcactataggctgtatcaatgtaccgcggcac

SEQ ID NO: 2354 - DNA, 669 bp, Plutella xylostella
gacgagaagatccgcatgaaccgcgtcgtccggaacaacctgcgagtgcgcctgtcagacattgtgtccatcgctccttgcccgtcagtgaagtacggcaagagagttcatattctgcccattgatgactctgttgagggtttgactggaaacctgttcgaagtctacctgaagccgtacttcatggaggcgtaccggcccatccaccgcgacgacacgttcatggtgcgcggcggcatgcgcgccgtcgagttcaaggtggtggagaccgacccctcgccctactgcatcgtggcccccgacacggtcattcattgtgagggagagccgattaaacgcgaggaagaagaggaggctctcaacgccgtcggctacgacgacatcggcgggtgccgcaagcagctggcgcagatcaaggagatggtggagctgccgctgcgccacccctcgctgttcaaggccatcggggtcaagccgccgcgggggatactgatgtacgggcccccggggacggggaagaccttgatcgctagggctgtcgctaatgagacgggcgcattcttcttcctcatcaacggccccgagatcatgtcgaaactcgccggtgaatccgagtcgaacctgcgcaaggcgttcgaggaggcggacaagaactctccggccatcatc

SEQ ID NO: 2355 - DNA, 44 bp, artificial sequence
  Description of artificial sequence:  synthetic primer
gcgtaatacgactcactatagggacgagaagatccgcatgaacc

SEQ ID NO: 2356 - DNA, 22 bp, artificial sequence
  Description of artificial sequence:  synthetic primer
gatgatggccggagagttcttg

SEQ ID NO: 2357 - DNA, 22 bp, artificial sequence
  Description of artificial sequence:  synthetic primer
gacgagaagatccgcatgaacc

SEQ ID NO: 2358 - DNA, 44 bp, artificial sequence
  Description of artificial sequence:  synthetic primer
gcgtaatacgactcactatagggatgatggccggagagttcttg

SEQ ID NO: 2359 - DNA, 741 bp, Plutella xylostella
ctgggtcgtattttcaacggctccggcaagcccatcgacaaggggcccccgatcctggccgaggagtacctggacatccaggggcagcccatcaacccgtggtcccgtatctacccggaggagatgatccagactggtatctccgctatcgacgtgatgaactccatcgcccgtggtcagaagatccccatcttctccgccgccggtctgccccacaacgagattgctgctcagatctgtaggcaggctggtcttgtcaaggtccccggaaaatccgtgttggacgaccacgaagacaacttcgccatcgtgttcgccgccatgggagtcaacatggagaccgccaggttcttcaagcaggacttcgaggagaacggttccatggagaacgtctgtctgttcttgaacttggccaatgacccgaccattgagaggattatcacgccgaggttggcgctgactgctgccgagttcttggcctaccagtgcgagaaacacgtgttggtaatcttgaccgacatgtcttcatacgcggaggctcttcgtgaagtgtcagccgcccgtgaggaggtgcccggacgacgtggtttcccaggttacatgtacacggatttggccacaatctacgagcgcgccgggcgagtcgagggccgcaacggctccatcacgcagatccccatcctgaccatgcccaacgacgacatcacccaccccatccccgacttgaccgggtacatcact

SEQ ID NO: 2360 - DNA, 45 bp, artificial sequence
  Description of artificial sequence:  synthetic primer
gcgtaatacgactcactataggctgggtcgtattttcaacggctc

SEQ ID NO: 2361 - DNA, 22 bp, artificial sequence
  Description of artificial sequence:  synthetic primer
agtgatgtacccggtcaagtcg

SEQ ID NO: 2362 - DNA, 23 bp, artificial sequence
  Description of artificial sequence:  synthetic primer
ctgggtcgtattttcaacggctc

SEQ ID NO: 2363 - DNA, 44 bp, artificial sequence
  Description of artificial sequence:  synthetic primer
gcgtaatacgactcactataggagtgatgtacccggtcaagtcg

SEQ ID NO: 2364 - DNA, 755 bp, Acheta domesticus
ggccccaagaagcatttgaagcgtttaaatgctcctaaagcatggatgttggacaaactcggaggagtattcgctcctcgccccagtactggcccccacaaattgcgtgaatgtttacctttggtgatttttcttcgcaatcggctcaagtatgctctgacgaactgtgaagtaacgaagattgttatgcagcgacttatcaaagttgacggcaaggtgcgaaccgatccgaattatcccgctggtttcatggatgttgtcaccattgagaagactggagagttcttcaggctggtgtatgatgtgaaaggccgtttcacaattcacagaattagtgcagaagaagccaagtacaagctctgcaaggtcaggagagttcaaactgggccaaaaggtattccattcttggtgacccatgatggccgtactatccgttatcctgacccagtcattaaagttaatgactcaatccaattggatattgccacttgtaaaatcatggaccacatcagatttgaatctggcaacctgtgtatgattactggtggacgtaacttgggtcgagtggggactgttgtgagtcgagaacgtcacccaggctcgtttgatattgttcatatcaaggatacccaaggacatacttttgccacaagattgaataatgtattcatcattggaaaagctacaaagccttacatttcattgccaaagggtaagggtgtgaaattgagtatcgccgaggagcgggacaagcg

SEQ ID NO: 2365 - protein, 251 aa, Acheta domesticus
GPKKHLKRLNAPKAWMLDKLGGVFAPRPSTGPHKLRECLPLVIFLRNRLKYALTNCEVTKIVMQRLIKVDGKVRTDPNYPAGFMDVVTIEKTGEFFRLVYDVKGRFTIHRISAEEAKYKLCKVRRVQTGPKGIPFLVTHDGRTIRYPDPVIKVNDSIQLDIATCKIMDHIRFESGNLCMITGGRNLGRVGTVVSRERHPGSFDIVHIKDTQGHTFATRLNNVFIIGKATKPYISLPKGKGVKLSIAEERDK

SEQ ID NO: 2366 - DNA, 396 bp, Acheta domesticus
gagtttctttagtaaagtattcggtgggaagaaagatggaaaggctccgaccactggtgaggccattcagaaactcagagaaacagaagaaatgttaatcaaaaagcaggaatttttagagaagaaaatcgaacaagaaatcaatgttgcaaagaaaaatggaacgaaaaataagcgagctgctattcaggctctgaaaaggaaaaagaggtatgaaaaacaattgcagcaaattgatggcaccttatccacaattgaaatgcaaagagaagctttggagggtgctaatactaatacagctgtattacaaacaatgaaatcagcagcagatgcccttaaagcagctcatcagcacatggatgtggacaaggtacatgacctgatggatgacattgc

SEQ ID NO: 2367 - protein, 131 aa, Acheta domesticus
SFFSKVFGGKKDGKAPTTGEAIQKLRETEEMLIKKQEFLEKKIEQEINVAKKNGTKNKRAAIQALKRKKRYEKQLQQIDGTLSTIEMQREALEGANTNTAVLQTMKSAADALKAAHQHMDVDKVHDLMDDI

SEQ ID NO: 2368 - DNA, 561 bp, Acheta domesticus
gagtcctagccgccttggttgcagtatgtttatgggtcttcttccagacactggatcctcgtattcccacctggcagttagattcttctatcattggcacatcacctggcctaggtttccggccaatgccagaagatagcaatgtagagtcaactctcatctggtaccgtggaacagatcgtgatgacttccgtcagtggacagacacccttgatgaatttcttgctgtgtacaagactcctggtctgacccctggtcgaggtcagaacatccacaactgtgactatgataagccgccaaagaaaggccaagtttgcaatgtggacatcaagaattggcatccctgcattcaagagaatcactacaactaccacaagagctctccatgcatattcatcaagctcaacaagatctacaattggatccctgaatactacaatgagagtacgaatttgcctgagcagatgccagaagacctgaagcagtacatccacaacctggagagtaacaactcgagggagatgaacacggtgtgggtgtcgtgcgagggagagaatccag

SEQ ID NO: 2369 - protein, 186 aa, Acheta domesticus
VLAALVAVCLWVFFQTLDPRIPTWQLDSSIIGTSPGLGFRPMPEDSNVESTLIWYRGTDRDDFRQWTDTLDEFLAVYKTPGLTPGRGQNIHNCDYDKPPKKGQVCNVDIKNWHPCIQENHYNYHKSSPCIFIKLNKIYNWIPEYYNESTNLPEQMPEDLKQYIHNLESNNSREMNTVWVSCEGENP

SEQ ID NO: 2370 - DNA, 1079 bp, Acheta domesticus
ggatgaactacagcttttccgaggagatacagttcttcttaaaggaaaaaggaggaaagaaactgtatgcatagtgttatcagatgatacatgtcctgatggaaaaataagaatgaatagagttgtacgcaacaatttacgtgttcgtttgtcagatgttgtatctgtacaaccttgtcctgatgttaagtatggaaaaaggatacatgtactaccaattgatgatacagttgaaggactaaccgggaatttgtttgaggtgtacttaaaaccgtactttctcgaagcataccgacccattcacaaagatgatgcgtttattgttcgtggtggtatgcgagcagtagaattcaaagtagtggaaacagatccttcaccatattgtattgttgctcctgatactgttattcactgtgaaggtgatccaataaaacgtgaagaggaagaagaagcattaaatgctgttggttatgatgacattgggggttgccgaaaacagctagcacagatcaaggaaatggtggaattgccattacggcaccccagtctctttaaggctattggtgttaagccaccgaggggaatactgctgtatggaccccctggaactggtaaaaccctcattgccagggctgtggctaatgaaactggtgcattcttctttttaataaatggtcctgaaattatgagcaagcttgctggtgaatctgaaagcaacttacgtaaggcatttgaagaagctgataagaatgctccggcaattatatttattgatgaactagatgcaattgcccctaaaagagaaaaaactcatggagaggtggaacgtcgcatagtttcacaactactaactttaatggatggtctgaagcaaagttcacatgttattgttatggctgccacaaatagacccaactctattgatggtgccttgcgccgctttggcagatttgatagggaaattgatattggtataccagatgccactggtcgccttgaaattcttcgtatccatactaagaatatgaagttagctgatgatgttgatttggaacagattgcagccgaatcccacggac

SEQ ID NO: 2371 - protein, 359 aa, Acheta domesticus
DELQLFRGDTVLLKGKRRKETVCIVLSDDTCPDGKIRMNRVVRNNLRVRLSDVVSVQPCPDVKYGKRIHVLPIDDTVEGLTGNLFEVYLKPYFLEAYRPIHKDDAFIVRGGMRAVEFKVVETDPSPYCIVAPDTVIHCEGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNAPAIIFIDELDAIAPKREKTHGEVERRIVSQLLTLMDGLKQSSHVIVMAATNRPNSIDGALRRFGRFDREIDIGIPDATGRLEILRIHTKNMKLADDVDLEQIAAESHG

SEQ ID NO: 2372 - DNA, 740 bp, Acheta domesticus
gttcaccggcgatattctgcgcgtgcccgtgtccgaggacatgctgggccgcaccttcaacggcagcggcatccccatcgacggcggcccgcccatcgtcgcagagacctacctcgacgtccagggcatgccgattaatcctcaaacgcgcatctacccggaagaaatgatccagacggggatctcgaccatcgacgtgatgacgtccatcgcgcgagggcagaagatccccatcttctcgggcgcagggctgccacacaacgagatcgctgcgcagatctgccgacaggcggggctggtgcagcacaaggagaacaaggacgacttcgccatcgtgttcgcggcgatgggcgtcaacatggagacggcgcgcttcttcaagcgcgagttcgcgcagacgggcgcgtgcaacgtggtgctgttcctcaacctggccaacgaccccaccatcgagcgcatcatcaccccgcgcctcgcgctcaccgtggccgagttcctggcctaccagtgcaacaagcacgtgctcgtcatcatgaccgacatgacctcctacgcggaggcgctgcgcgaggtgagcgcggcgcgcgaggaggttcctgggcgaagaggcttcccaggctacatgtacaccgatctctccaccatctacgagcgcgctggccgtgtgcaaggccgccccggctccatcactcagatccccatcctgacgatgcccaacgacgacatcacccatcctattc

SEQ ID NO: 2373 - protein, 246 aa, Acheta domesticus
FTGDILRVPVSEDMLGRTFNGSGIPIDGGPPIVAETYLDVQGMPINPQTRIYPEEMIQTGISTIDVMTSIARGQKIPIFSGAGLPHNEIAAQICRQAGLVQHKENKDDFAIVFAAMGVNMETARFFKREFAQTGACNVVLFLNLANDPTIERIITPRLALTVAEFLAYQCNKHVLVIMTDMTSYAEALREVSAAREEVPGRRGFPGYMYTDLSTIYERAGRVQGRPGSITQIPILTMPNDDITHPI

SEQ ID NO: 2374 - DNA, 23 bp, artificial sequence
  Description of artificial sequence:  synthetic primer
ggccccaagaagcatttgaagcg

SEQ ID NO: 2375 - DNA, 23 bp, artificial sequence
  Description of artificial sequence:  synthetic primer
  misc_feature (18)..(18): n is a, c, g, or t
cgcttgtcccgctcctcngcrat

SEQ ID NO: 2376 - DNA, 27 bp, artificial sequence
  Description of artificial sequence:  synthetic primer
gagtttctttagtaaagtattcggtgg

SEQ ID NO: 2377 - DNA, 26 bp, artificial sequence
  Description of artificial sequence:  synthetic primer
gcaatgtcatccatcakrtcrtgtac

SEQ ID NO: 2378 - DNA, 22 bp, artificial sequence
  Description of artificial sequence:  synthetic primer
gagtcctagccgcvytsgtkgc

SEQ ID NO: 2379 - DNA, 26 bp, artificial sequence
  Description of artificial sequence:  synthetic primer
ctggattctctccctcgcamgahacc

SEQ ID NO: 2380 - DNA, 24 bp, artificial sequence
  Description of artificial sequence:  synthetic primer
ggatgaactacagctbttccghgg

SEQ ID NO: 2381 - DNA, 23 bp, artificial sequence
  Description of artificial sequence:  synthetic primer
gtccgtgggaytcrgchgcaatc

SEQ ID NO: 2382 - DNA, 21 bp, artificial sequence
  Description of artificial sequence:  synthetic primer
gttcaccggcgayatyctgcg

SEQ ID NO: 2383 - DNA, 24 bp, artificial sequence
  Description of artificial sequence:  synthetic primer
ggaataggatgggtratrtcgtcg

SEQ ID NO: 2384 - DNA, 21 bp, Acheta domesticus
aaagcatggatgttggacaaa

SEQ ID NO: 2385 - DNA, 23 bp, Acheta domesticus
aaagcatggatgttggacaaact

SEQ ID NO: 2386 - DNA, 68 bp, Acheta domesticus
aaaggtattccattcttggtgacccatgatggccgtactatccgttatcctgacccagtcattaaagt

SEQ ID NO: 2387 - DNA, 47 bp, Acheta domesticus
aactgtgaagtaacgaagattgttatgcagcgacttatcaaagttga

SEQ ID NO: 2388 - DNA, 23 bp, Acheta domesticus
aagaagcatttgaagcgtttaaa

SEQ ID NO: 2389 - DNA, 26 bp, Acheta domesticus
aagggtaagggtgtgaaattgagtat

SEQ ID NO: 2390 - DNA, 23 bp, Acheta domesticus
aatgtattcatcattggaaaagc

SEQ ID NO: 2391 - DNA, 22 bp, Acheta domesticus
agaagcatttgaagcgtttaaa

SEQ ID NO: 2392 - DNA, 25 bp, Acheta domesticus
agaagcatttgaagcgtttaaatgc

SEQ ID NO: 2393 - DNA, 23 bp, Acheta domesticus
agtactggcccccacaaattgcg

SEQ ID NO: 2394 - DNA, 26 bp, Acheta domesticus
agtgcagaagaagccaagtacaagct

SEQ ID NO: 2395 - DNA, 22 bp, Acheta domesticus
atcgccgaggagcgggacaagc

SEQ ID NO: 2396 - DNA, 50 bp, Acheta domesticus
caaggacatacttttgccacaagattgaataatgtattcatcattggaaa

SEQ ID NO: 2397 - DNA, 22 bp, Acheta domesticus
cagaagaagccaagtacaagct

SEQ ID NO: 2398 - DNA, 23 bp, Acheta domesticus
catgatggccgtactatccgtta

SEQ ID NO: 2399 - DNA, 32 bp, Acheta domesticus
catgatggccgtactatccgttatcctgaccc

SEQ ID NO: 2400 - DNA, 23 bp, Acheta domesticus
catttgaagcgtttaaatgctcc

SEQ ID NO: 2401 - DNA, 21 bp, Acheta domesticus
cctaaagcatggatgttggac

SEQ ID NO: 2402 - DNA, 23 bp, Acheta domesticus
cctaaagcatggatgttggacaa

SEQ ID NO: 2403 - DNA, 24 bp, Acheta domesticus
cctaaagcatggatgttggacaaa

SEQ ID NO: 2404 - DNA, 26 bp, Acheta domesticus
cctaaagcatggatgttggacaaact

SEQ ID NO: 2405 - DNA, 23 bp, Acheta domesticus
cgtactatccgttatcctgaccc

SEQ ID NO: 2406 - DNA, 38 bp, Acheta domesticus
gaatgtttacctttggtgatttttcttcgcaatcggct

SEQ ID NO: 2407 - DNA, 23 bp, Acheta domesticus
gcagaagaagccaagtacaagct

SEQ ID NO: 2408 - DNA, 23 bp, Acheta domesticus
gcatggatgttggacaaactcgg

SEQ ID NO: 2409 - DNA, 23 bp, Acheta domesticus
gctggtttcatggatgttgtcac

SEQ ID NO: 2410 - DNA, 28 bp, Acheta domesticus
ggccccaagaagcatttgaagcgtttaa

SEQ ID NO: 2411 - DNA, 23 bp, Acheta domesticus
ggtttcatggatgttgtcaccat

SEQ ID NO: 2412 - DNA, 35 bp, Acheta domesticus
tatgatgtgaaaggccgtttcacaattcacagaat

SEQ ID NO: 2413 - DNA, 21 bp, Acheta domesticus
tcattgccaaagggtaagggt

SEQ ID NO: 2414 - DNA, 49 bp, Acheta domesticus
tggatattgccacttgtaaaatcatggaccacatcagatttgaatctgg

SEQ ID NO: 2415 - DNA, 35 bp, Acheta domesticus
ttaaatgctcctaaagcatggatgttggacaaact

SEQ ID NO: 2416 - DNA, 26 bp, Acheta domesticus
tttgaatctggcaacctgtgtatgat

SEQ ID NO: 2417 - DNA, 26 bp, Acheta domesticus
tttgatattgttcatatcaaggatac

SEQ ID NO: 2418 - DNA, 21 bp, Acheta domesticus
aagaaaatcgaacaagaaatc

SEQ ID NO: 2419 - DNA, 23 bp, Acheta domesticus
cagcacatggatgtggacaaggt

SEQ ID NO: 2420 - DNA, 27 bp, Acheta domesticus
gagtttctttagtaaagtattcggtgg

SEQ ID NO: 2421 - DNA, 21 bp, Acheta domesticus
cactacaactaccacaagagc

SEQ ID NO: 2422 - DNA, 22 bp, Acheta domesticus
cagaacatccacaactgtgact

SEQ ID NO: 2423 - DNA, 21 bp, Acheta domesticus
ggtgtgggtgtcgtgcgaggg

SEQ ID NO: 2424 - DNA, 23 bp, Acheta domesticus
tggatccctgaatactacaatga

SEQ ID NO: 2425 - DNA, 22 bp, Acheta domesticus
gagcagtagaattcaaagtagt

SEQ ID NO: 2426 - DNA, 21 bp, Acheta domesticus
gcaattatatttattgatgaa

SEQ ID NO: 2427 - DNA, 21 bp, Acheta domesticus
tcaccatattgtattgttgct

SEQ ID NO: 2428 - DNA, 21 bp, Acheta domesticus
ttgtcctgatgttaagtatgg

SEQ ID NO: 2429 - DNA, 29 bp, Acheta domesticus
acgatgcccaacgacgacatcacccatcc

SEQ ID NO: 2430 - DNA, 23 bp, Acheta domesticus
atgcccaacgacgacatcaccca

SEQ ID NO: 2431 - DNA, 30 bp, Acheta domesticus
atgcccaacgacgacatcacccatcctatt

SEQ ID NO: 2432 - DNA, 22 bp, Acheta domesticus
cagaagatccccatcttctcgg

SEQ ID NO: 2433 - DNA, 24 bp, Acheta domesticus
cggctccatcactcagatccccat

SEQ ID NO: 2434 - DNA, 21 bp, Acheta domesticus
gccaacgaccccaccatcgag

SEQ ID NO: 2435 - DNA, 24 bp, Acheta domesticus
gcccgtgtccgaggacatgctggg

SEQ ID NO: 2436 - DNA, 22 bp, Acheta domesticus
ggcagaagatccccatcttctc

SEQ ID NO: 2437 - DNA, 21 bp, Acheta domesticus
gttcaccggcgatattctgcg

SEQ ID NO: 2438 - DNA, 22 bp, Acheta domesticus
gttcaccggcgatattctgcgc

SEQ ID NO: 2439 - DNA, 22 bp, Acheta domesticus
ataaatggtcctgaaattatga

SEQ ID NO: 2440 - DNA, 23 bp, Acheta domesticus
gtcaacatggagacggcgcgctt

SEQ ID NO: 2441 - DNA, 21 bp, Acheta domesticus
cccgctggtttcatggatgtt

SEQ ID NO: 2442 - DNA, 24 bp, Acheta domesticus
gacaacatccatgaaaccagcggg

SEQ ID NO: 2443 - DNA, 22 bp, Acheta domesticus
ttcatggatgttgtcaccattg

SEQ ID NO: 2444 - DNA, 23 bp, Acheta domesticus
gaagaagccaagtacaagctctg

SEQ ID NO: 2445 - DNA, 22 bp, Acheta domesticus
aagaagccaagtacaagctctg

SEQ ID NO: 2446 - DNA, 23 bp, Acheta domesticus
gccaagtacaagctctgcaaggt

SEQ ID NO: 2447 - DNA, 25 bp, Acheta domesticus
gccaagtacaagctctgcaaggtca

SEQ ID NO: 2448 - DNA, 21 bp, Acheta domesticus
agtacaagctctgcaaggtca

SEQ ID NO: 2449 - DNA, 27 bp, Acheta domesticus
tatggaccccctggaactggtaaaacc

SEQ ID NO: 2450 - DNA, 28 bp, Acheta domesticus
tgcccgtgtccgaggacatgctgggccg

SEQ ID NO: 2451 - DNA, 29 bp, Acheta domesticus
tgcccgtgtccgaggacatgctgggccgc

SEQ ID NO: 2452 - DNA, 26 bp, Acheta domesticus
cgtgtccgaggacatgctgggccgca

SEQ ID NO: 2453 - DNA, 23 bp, Acheta domesticus
atgggcgtcaacatggagacggc

SEQ ID NO: 2454 - DNA, 21 bp, Acheta domesticus
tggagacggcgcgcttcttca

SEQ ID NO: 2455 - DNA, 26 bp, Acheta domesticus
ttcctcaacctggccaacgaccccac

SEQ ID NO: 2456 - DNA, 32 bp, Acheta domesticus
accatcgagcgcatcatcaccccgcgcctcgc

SEQ ID NO: 2457 - DNA, 23 bp, Acheta domesticus
tccaccatctacgagcgcgctgg

SEQ ID NO: 2458 - DNA, 26 bp, Acheta domesticus
ctgacgatgcccaacgacgacatcac

SEQ ID NO: 2459 - DNA, 23 bp, Acheta domesticus
atgcccaacgacgacatcaccca

SEQ ID NO: 2460 - DNA, 23 bp, Acheta domesticus
tgggtgatgtcgtcgttgggcat

SEQ ID NO: 2461 - DNA, 583 bp, Acheta domesticus
gctcctaaagcatggatgttggacaaactcggaggagtattcgctcctcgccccagtactggcccccacaaattgcgtgaatgtttacctttggtgatttttcttcgcaatcggctcaagtatgctctgacgaactgtgaagtaacgaagattgttatgcagcgacttatcaaagttgacggcaaggtgcgaaccgatccgaattatcccgctggtttcatggatgttgtcaccattgagaagactggagagttcttcaggctggtgtatgatgtgaaaggccgtttcacaattcacagaattagtgcagaagaagccaagtacaagctctgcaaggtcaggagagttcaaactgggccaaaaggtattccattcttggtgacccatgatggccgtactatccgttatcctgacccagtcattaaagttaatgactcaatccaattggatattgccacttgtaaaatcatggaccacatcagatttgaatctggcaacctgtgtatgattactggtggacgtaacttgggtcgagtggggactgttgtgagtcgagaacgtcacccaggctcgtttgatattg

SEQ ID NO: 2462 - DNA, 44 bp, artificial sequence
  Description of artificial sequence:  synthetic primer
gcgtaatacgactcactatagggctcctaaagcatggatgttgg

SEQ ID NO: 2463 - DNA, 22 bp, artificial sequence
  Description of artificial sequence:  synthetic primer
caatatcaaacgagcctgggtg

SEQ ID NO: 2464 - DNA, 22 bp, artificial sequence
  Description of artificial sequence:  synthetic primer
gctcctaaagcatggatgttgg

SEQ ID NO: 2465 - DNA, 44 bp, artificial sequence
  Description of artificial sequence:  synthetic primer
gcgtaatacgactcactataggcaatatcaaacgagcctgggtg

SEQ ID NO: 2466 - DNA, 335 bp, Acheta domesticus
gaagaaagatggaaaggctccgaccactggtgaggccattcagaaactcagagaaacagaagaaatgttaatcaaaaagcaggaatttttagagaagaaaatcgaacaagaaatcaatgttgcaaagaaaaatggaacgaaaaataagcgagctgctattcaggctctgaaaaggaaaaagaggtatgaaaaacaattgcagcaaattgatggcaccttatccacaattgaaatgcaaagagaagctttggagggtgctaatactaatacagctgtattacaaacaatgaaatcagcagcagatgcccttaaagcagctcatcagcacatggatg

SEQ ID NO: 2467 - DNA, 46 bp, artificial sequence
  Description of artificial sequence:  synthetic primer
gcgtaatacgactcactatagggaagaaagatggaaaggctccgac

SEQ ID NO: 2468 - DNA, 22 bp, artificial sequence
  Description of artificial sequence:  synthetic primer
catccatgtgctgatgagctgc

SEQ ID NO: 2469 - DNA, 24 bp, artificial sequence
  Description of artificial sequence:  synthetic primer
gaagaaagatggaaaggctccgac

SEQ ID NO: 2470 - DNA, 44 bp, artificial sequence
  Description of artificial sequence:  synthetic primer
gcgtaatacgactcactataggcatccatgtgctgatgagctgc

SEQ ID NO: 2471 - DNA, 495 bp, Acheta domesticus
gtcttcttccagacactggatcctcgtattcccacctggcagttagattcttctatcattggcacatcacctggcctaggtttccggccaatgccagaagatagcaatgtagagtcaactctcatctggtaccgtggaacagatcgtgatgacttccgtcagtggacagacacccttgatgaatttcttgctgtgtacaagactcctggtctgacccctggtcgaggtcagaacatccacaactgtgactatgataagccgccaaagaaaggccaagtttgcaatgtggacatcaagaattggcatccctgcattcaagagaatcactacaactaccacaagagctctccatgcatattcatcaagctcaacaagatctacaattggatccctgaatactacaatgagagtacgaatttgcctgagcagatgccagaagacctgaagcagtacatccacaacctggagagtaacaactcgagggagatgaacacg

SEQ ID NO: 2472 - DNA, 47 bp, artificial sequence
  Description of artificial sequence:  synthetic primer
gcgtaatacgactcactatagggtcttcttccagacactggatcctc

SEQ ID NO: 2473 - DNA, 22 bp, artificial sequence
  Description of artificial sequence:  synthetic primer
cgtgttcatctccctcgagttg

SEQ ID NO: 2474 - DNA, 25 bp, artificial sequence
  Description of artificial sequence:  synthetic primer
gtcttcttccagacactggatcctc

SEQ ID NO: 2475 - DNA, 44 bp, artificial sequence
  Description of artificial sequence:  synthetic primer
gcgtaatacgactcactataggcgtgttcatctccctcgagttg

SEQ ID NO: 2476 - DNA, 776 bp, Acheta domesticus
gttgaaggactaaccgggaatttgtttgaggtgtacttaaaaccgtactttctcgaagcataccgacccattcacaaagatgatgcgtttattgttcgtggtggtatgcgagcagtagaattcaaagtagtggaaacagatccttcaccatattgtattgttgctcctgatactgttattcactgtgaaggtgatccaataaaacgtgaagaggaagaagaagcattaaatgctgttggttatgatgacattgggggttgccgaaaacagctagcacagatcaaggaaatggtggaattgccattacggcaccccagtctctttaaggctattggtgttaagccaccgaggggaatactgctgtatggaccccctggaactggtaaaaccctcattgccagggctgtggctaatgaaactggtgcattcttctttttaataaatggtcctgaaattatgagcaagcttgctggtgaatctgaaagcaacttacgtaaggcatttgaagaagctgataagaatgctccggcaattatatttattgatgaactagatgcaattgcccctaaaagagaaaaaactcatggagaggtggaacgtcgcatagtttcacaactactaactttaatggatggtctgaagcaaagttcacatgttattgttatggctgccacaaatagacccaactctattgatggtgccttgcgccgctttggcagatttgatagggaaattgatattggtataccagatgccactggtcgccttgaaattct

SEQ ID NO: 2477 - DNA, 46 bp, artificial sequence
  Description of artificial sequence:  synthetic primer
gcgtaatacgactcactatagggttgaaggactaaccgggaatttg

SEQ ID NO: 2478 - DNA, 22 bp, artificial sequence
  Description of artificial sequence:  synthetic primer
agaatttcaaggcgaccagtgg

SEQ ID NO: 2479 - DNA, 24 bp, artificial sequence
  Description of artificial sequence:  synthetic primer
gttgaaggactaaccgggaatttg

SEQ ID NO: 2480 - DNA, 44 bp, artificial sequence
  Description of artificial sequence:  synthetic primer
gcgtaatacgactcactataggagaatttcaaggcgaccagtgg

SEQ ID NO: 2481 - DNA, 469 bp, Acheta domesticus
acccggaagaaatgatccagacggggatctcgaccatcgacgtgatgacgtccatcgcgcgagggcagaagatccccatcttctcgggcgcagggctgccacacaacgagatcgctgcgcagatctgccgacaggcggggctggtgcagcacaaggagaacaaggacgacttcgccatcgtgttcgcggcgatgggcgtcaacatggagacggcgcgcttcttcaagcgcgagttcgcgcagacgggcgcgtgcaacgtggtgctgttcctcaacctggccaacgaccccaccatcgagcgcatcatcaccccgcgcctcgcgctcaccgtggccgagttcctggcctaccagtgcaacaagcacgtgctcgtcatcatgaccgacatgacctcctacgcggaggcgctgcgcgaggtgagcgcggcgcgcgaggaggttcctgggcgaagaggcttcccaggctacat

SEQ ID NO: 2482 - DNA, 44 bp, artificial sequence
  Description of artificial sequence:  synthetic primer
gcgtaatacgactcactataggacccggaagaaatgatccagac

SEQ ID NO: 2483 - DNA, 22 bp, artificial sequence
  Description of artificial sequence:  synthetic primer
atgtagcctgggaagcctcttc

SEQ ID NO: 2484 - DNA, 22 bp, artificial sequence
  Description of artificial sequence:  synthetic primer
acccggaagaaatgatccagac

SEQ ID NO: 2485 - DNA, 44 bp, artificial sequence
  Description of artificial sequence:  synthetic primer
gcgtaatacgactcactataggatgtagcctgggaagcctcttc

What is claimed is:

1. An isolated double stranded ribonucleotide (RNA) molecule, wherein the RNA molecule is a pest control agent targeting a gene encoding beta-coatomer, wherein the RNA molecule comprises complementary strands, wherein one strand of the RNA molecule is produced from the expression of a polynucleotide molecule selected from the group consisting of:
   (a) a polynucleotide molecule comprising the nucleic acid sequence set forth in SEQ ID NO: 23, or a fragment of at least 21 nucleotides thereof; and
   (b) a polynucleotide molecule comprising a nucleic acid sequence at least 85% identical to SEQ ID NO: 23, wherein ingestion of said RNA molecule by a pest results in down-regulation of the target gene in the pest.

2. A cell transformed with the RNA molecule of claim 1.

3. The cell of claim 2, wherein said cell is a bacterial, yeast, or algal cell.

4. A food product comprising the cell of claim 3.

5. A composition comprising the double stranded ribonucleotide molecule of claim 1, wherein said composition is selected from the group consisting of a spray, powder, pellet, gel, and capsule.

6. A method for controlling pest infestation, comprising exposing a pest to a composition comprising the double stranded ribonucleotide molecule of claim 1.

7. A pesticide comprising the double stranded ribonucleotide molecule of claim 1, wherein the pesticide is any substance or mixture of substances intended for preventing, destroying, repelling, or mitigating any pest.

8. A method for protecting an object from pest infestation, comprising treating the surface of said object with a composition comprising the double stranded ribonucleotide molecule of claim 1.

9. The method of claim 8, wherein said object is selected from the group consisting of wood, tree, book binding, cloth, and a food storage container.

10. A vector encoding the double stranded RNA molecule of claim 1.

* * * * *